United States Patent 12,569,549 (FLAVIVIRUS VACCINE) - sequence listing, part 11

SEQ ID NO: 6470 - RNA, 9876 nt, synthetic construct
  misc_feature 1..9876: note = derived and/or modified CDS sequence (wt) from DENV-2__FJ850088__SS-prME
  source 1..9876: mol_type = other RNA
acagcaggtgtgattgttatgttgattccaacagtgatggcgtttcatttaaccacacgcaatggagaaccacacatgatcgttggcaggcaggagaaagggaaaagtctcctgtttaaaacagaggatggtgtcaacatgtgcaccctcatggccatagaccttggtgaattgtgtgaagatacaatcacgtacaagtgtcctctcctcagacaaaatgaaccagaagacatagattgttggtgcaactctacatccacatgggtaacttatgggacatgtaccaccacaggagaacacagaagagagaaaagatcagtggcgctcgttccacatgtgggtatgggactggagacacgaactgaaacatggatgtcatcagaaggggcctggaaacatgttcagagaattgaaacctggatcttgagacatccaggctttaccatgatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactaataaaaacagaagccaaacaacctgccactcttaggaagtactgtgtagaagcaaagctgaccaacacaacaacagaatctcgttgcccaacacaaggggaacccagtctaaatgaagagcaggacaaaaggttcatttgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcatgctgtaggtaatgacacaggaaagcatggcaaggaagtcaaaataacaccacagagttctatcacagaagcagaactgacaggctatggtactgtcacgatggagtgctctccgagaacgggcctcgacttcaatgagatggtgctgctgcagatggaagacaaagcttggctggtacacaggcaatggttcctagacctgccgttaccatggctacccggagcggacacacaaggatcaaattggatacaaaaagagacattggtcactttcaaaaatccccacgcgaagaaacaggatgtcgttgttttagggtctcaggaaggggctatgcatacggcactcacaggggctacagaaatccagatgtcatcaggaaacttactgttcacaggacatctcaaatgcaggctgagaatggacaaactacagctcaaaggaatgtcatactctatgtgcacaggaaagtttaaaattgtgaaggaaatagcagaaacgcaacatggaacaatagttatcagagtacaatatgaaggggacggttctccatgtaagatcccttttgagataatggatctggaaaaaagacacgtcttaggccgcctgatcacagttaacccaatcgtaacagaaaaagatagcccagtcaacatagaagcagaacctccattcggagacagctacatcatcgtaggagtagagccgggacaattgaaactcaattggtttaagaagggaagttccatcggccaaatgtttgagacaacgatgagaggagcaaagagaatggccattttaggtgacacagcctgggattttggatccctgggaggagtgtttacatctataggaaaggctctccaccaagttttcggagcaatctatggggctgcttttaatggggtctcatggactatgaaaatcctcattggagtcatcatcacatggataggaatgaattcacgtagcacctcactgtctgtgtcgctagtattggtgggagtcgtgacactatacctgggagctatggtgcaggctgacagtggttgcgttgtgagctggaaaaataaagaactgaaatgtggcagcgggatcttcattacagacaacgtgcacacatggacagaacaatataagttccaaccagaatccccttcaaagctagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccacagagttgaaatactcatggaaaacatggggaaaggcgaaaatgctccccacagagtctcacaatcagacctttctcattgatggccccgaaacagcagaatgccccaacgcaaacagagcttggaactcgctggaagtcgaagactatggttttggagtttttaccaccaatatatggctaaagttgagagaaaaacaggatgtattttgtgactcaaaactcatgtcagcggccattaaagacaacagagccgtccatgctgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggcaagcttgagatggactttgatttctgcgaaggaactacagtggtggtgactgaggattgtggaaatagaggaccttctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgagtaggaacgaaacatgcaatactgctagttgcagtatctcttgtgacattgattactgggaacatgtcttttagagacctgggaagagtgatggttatggtgggcgctactatgacggatgacataggtatgggagtgacttatcttgccctactagcagctttcaaagttagaccaacttttgcagctggactactcttgagaaaactgacttccaaggaattaatgatggccaccataggagtcgctctcctttcccaaagcaccataccagagaccattcttgaactgactgatgcgttagccttgggcatgatggctctcaaagtagtgaaaaatatggaaaagtatcaattggcagtgactatcatggccatttcgtgcgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacgactctttcgagaaccagcaagaaaaggagctggccactaaatgaagctgtcatggcagttgggatggtgagcattttagccagttctctcctgaagaatgatattcccatgacaggtccattagtggctggagggctccttacagtatgttatgtgctcactggacgatcggccgatttggaactagagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggccggagtattgtgggacgtcccttcacccccaccagtagaaaaagctgaactggaagatggagcctatagaatcaagcaaagagggattctaggatattctcagattggagccggagtttacaaagaaggaacattccatacgatgtggcacgtcacacgtggtgctgttctgatgcatagagggaagaggattgaaccatcatgggcagatgtcaagaaagacctagtgtcatatggaggaggctggaagctagaaggagaatggaaagaaggagaggaagtccaagtcctggcattagaacctggaaaaaatccaagagccgtccaaacgaaacctggaattttcaaaaccaacaccggaaccataggcgccgtatctctggacttttcccctggaacgtcaggatctccaattgttgacagaaaaggaaaagttgtgggtctttacggtaatggtgttgtcacaaggagtggagcatacgtaagtgctatagcccagaccgaaaaaagcattgaagacaatccagagatcgaagatgacattttccgaaagaaaagactgaccatcatggacctccatccaggagcaggaaagacaaaaagataccttccagccatagttagagaagccataaaacgtggcttgagaacattaatcctggctcccaccagagtcgtggcagctgaaatggaagaagctcttagaggacttccaataagataccaaaccccagccatcagagccgaacacaccgggcgggagatcgtggacctaatgtgtcatgccacatttactatgaggctgctatcaccagtcagagtgccaaattacaacctgatcatcatggacgaagcccacttcacagacccagcaagcatagcagctagaggatatatttcaactcgggtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatcgcagcttgtcttaggaaaaatggaaagaaagtgatacaactcagtagaaagacttttgattctgagtatgttaagactagatccaatgattgggattttgtggtcacaactgacatttcagaaatgggtgccaacttcaaggctgagagggttatagaccccagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgacgaagactgtgcacattggaaagaagccaaaatgctcctagataatatcaacacacccgaaggaatcattcctagtatgttcgaaccagagcgtgaaaaagtggatgccattgatggtgaataccgtttgagaggagaagcaaggaaaacctttgtggacctaatgagaagaggggacttacctgtctggttagcctacaaagtggcagctgaaggcatcaactacgcagacagaaggtggtgttttgatggaattaagaataatcaaatactggaagaaaatgtggaagtggaaatctggacgaaagaaggggaaaggaaaaaattaaaacccagatggttggatgctaggatctattctgacccactggcactaaaagaattcaaggaatttgcagctgggagaaaatctttgaccctgaacctaatcacagaaatgggtaggctcccaactttcatgactcagaaggcaagaaacgcactggacaacttggctgtgctgcatacggctgaggcaggtggaaaggcgtacaatcatgctctcagtgaactgccggagaccctggagacactgcttctactggcactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgcttattccagaaccagaaaaacagagaacacctcaagacaaccaattgacctacgttgtcatagccatcctcacagtagtggccgcaaccatggcgaacgagatgggtttcctggaaaaaactaagaaagacctcggattgggaagcattacaacccaggaatctgagagcaacatcttggacatagatctacgtcctgcatcagcatggacgttgtatgccgtggctacaacatttgtcacaccaatgttgaggcatagcattgaaaattcctcagtgaatgtctccctaacagccattgctaaccaagctacagtgctgatgggtcttgggaaaggatggccattgtcaaagatggacatcggagttcccctcctcgccattggatgctactcacaagtcaaccctataactctcacagcagctcttctcttattggtagcacactatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccttagcgaccgggcccatctccacattgtgggaaggaaatccagggaggttttggaacactactattgcagtgtcaatggctaacatctttagggggagctacttggccggagctggacttctcttttccgtcatgaagaacacaacaaacacaagaagaggaactggcaacataggagagacacttggagaaaaatggaaaagccgattaaacgcactgggaaaaagtgaatttcagatctacaagaagagtggaatccaggaagtggatagaaccctggcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactactgtgggggactaaaaaatgtaagagaagtcaaaggcctaacaagaggaggaccaggacacgaagaacctatccccatgtcaacatatgggtggaatctagtgcgtctgcaaagtggagttgacgttttcttcaccccgccagaaaagtgtgatacattgttgtgtgacataggggagtcgtcaccaaatcccacaatagaagcaggacgaacactcagagtcctcaacctagtggaaaattggttgaacaataatacccaattttgcataaaggtcctcaacccatatatgccctcagtaatagaaaaaatggaaacactacaaaggacatatggaggagccttagtgaggaatccactctcacgaaactccacgcatgagatgtattgggtatctaatgccaccgggaacatagtgtcatcagtgaacatgatctcaaggatgttgatcaacagattcacaatgaaacacaagaaggccacctacgagccagatgttgacctaggaagtggaactcgcaacattggaattgaaagtgagataccaaatctagacataataggaaagagaatagagaaaataaagcaagagcatgagacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtattcaaagaaaaagtggatacgagaacccaagaaccgaaggaaggcacaaagaaactgatgaaaattacggcagagtggctttggaaagaactaggaaagaaaaagacacctaggatgtgtaccagagaggaattcacaagaaaggtgagaagcaatgcagccttgggggccatattcactgatgagaacaaatggaaatcggcacgtgaggctgttgaagatggcaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccttaggattcctgaatgaagatcactggttctccagagggaactccctgagtggagtggaaggagaagggctgcacaggctaggctacatcttaagagacgtgagcaggaaggaagggggagcaatgtacgctgatgatacggcaggatgggacacaagaatcacactagaagacttaaaaaatgaagaaatggtaacaaaccacatgaaaggagaacacaagaaactagccgaggccatattcaaattaacgtaccaaaacaaagtggtgcgtgtgcaaagaccaacaccaagaggcacagtaatggatatcatatcgagaagagaccaaagaggcagtggacaagtcggcacttacggccttaatactttcaccaacatggaagcccaattaatcagacagatggagggagaaggaatcttcaaaagcattcagcacctgacagtcacagaagaaatcgctgtacagaactggctagcaagagtggggcgtgaaaggctaacaagaatggccatcagtggagatgattgtgttgtaaaacctatagatgacagatttgcaaatgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagccgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgtggctcattgattgggctaacaagtagggctacctgggcaaagaacatccaaacagcaataaaccaagtcagatccctcataggtaatgaggaatatacagactacatgccatccatgaagagattcagaagggaagaggaagaggcaggtgtcctgtggtag

SEQ ID NO: 6471 - RNA, 9876 nt, synthetic construct
  misc_feature 1..9876: note = derived and/or modified CDS sequence (wt) from DENV-2__FJ850091__SS-prME
  source 1..9876: mol_type = other RNA
acagcaggcgtaattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatggaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcggaaggggcctggaagcatgttcagagaattgaaacctggatcttgagacatccaggttttaccataatggcagcgatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagctacatcatcgtaggagtagagccgggacaactgaaactcaattggtttaagaagggaagctccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaattagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaataggggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcattgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgagcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagatctaatatcatatgggggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgctaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgctgacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggctgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaataaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcatccagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctatggtag

SEQ ID NO: 6472 - RNA, 9876 nt, synthetic construct
  misc_feature 1..9876: note = derived and/or modified CDS sequence (wt) from DENV-2__GQ199890__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacatacaagtgtcccctcctcagacaaaatgaaccagaagacatagattgttggtgcaactctacgtccacatgggtaacttatgggacatgtaccaccataggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcgcgctgtaggtaatgacacaggaaagcatggcaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcatagacaatggttcctagacctgccgttaccatggctacccggagcggatacacaaggatcaaattggatacagaaggagacattggtcactttcaaaaatccccacgccaagaaacaggatgttgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccctttgagataacagatttggaaaaaagacacgtcttgggacgcctgattacagttaacccaatcgtaacagaaaaagatagcccagtcaacatagaagcagaacctccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcattacatggataggaatgaattcacgtagcacctcactgtctgtgtcgctagtattggtgggagttgtgacactgtacctgggagctatggtgcaggctgatagtggttgcattgtgagctggaaaaacaaagaactgaaatgtggcagcgggatcttcattacagataacgtacacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagagaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcattgacgataaaaggtctcaacccaacagccatttttctaacaactctttcgagaaccagcaagaaaaggagctggccgctaaatgaagccatcatggcagtcgggatggtgagcattttagccagttctctcctaaagaatgatattcctatgacaggtccattagtggctggagggctcctcaccgtatgttacgtgctcactggacgatcggccgacttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagatctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagctataaaacgtggcttgagaacattaatcctggctcccactagagtcgtggcagctgaaatggaggaagctcttagaggacttccaataagataccaaaccccagccatcagagccgagcacaccgggcgagagatcgtggacctaatgtgtcatgccacatttactatgaggctgctatcaccagtcagagtaccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaaggagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaatgcactggacaacctggctgtgctgcatacggctgaggtaggtggaaaggcgtacactcatgctctcagtgaactgccggagactctggagacactgcttctactgacactcctggcaacaatcacaggaggaatcttcttattcttaatgagcggaaaaggtatagggaagatgactctgggaatgtgttgcataatcacagctagcattctcctatggtatgcacagatacaaccacactggatagcagcttcaataatattggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagatctcggatttggaaccattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagcggggtcgacgttttcttcaccccgccagagaagtgtgatacattgttgtgtgacataggggagtcgtcaccaaatcccacgatagaagcaggacgaacacttagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtaacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctagaatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagttggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaaaggaagaggaagaggcaggtgtcctgtggtag

SEQ ID NO: 6473 - RNA, 9876 nt, synthetic construct
  misc_feature 1..9876: note = derived and/or modified CDS sequence (wt) from DENV-2__GQ868549__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatcgttctagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccggaaaatttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacgatggagtgctccccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggattttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggttaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccgaatgcagtgatattgcaaaacgcatggaaggtgagttgcacaatattggcagcggtgtccgtttctccactgctcctaacatcctcacagcagaaagcggattggataccactggcattgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttttgatgcatagagggaaaaggattgaaccatcatgggcagatgtcaagaaagatctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaatcccacgatagaggcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttttgttcacaccattttcatgagttagtcatgaaagatggtcgcgtgctcgtagtcccatgcagaaaccaagatgaattgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttatgggcaatgagggatacacagactacatgccatccatgaagagattcagaagggaagaggaagaggcaggtgtcctgtggtag

SEQ ID NO: 6474 - RNA, 9876 nt, synthetic construct
  misc_feature 1..9876: note = derived and/or modified CDS sequence (wt) from DENV-2__GQ868551__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacactataggaacgacacacttccaaagggccttgattttcatcttactgacagctgtcgctccttcaatgacaatgcgctgcataggaatatcaaatagagacttcgtagaaggggtttcaggaggaagctgggttgacatcgttctagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccggaaaatttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacgatggagtgctccccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggtgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggattttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggttaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctgctagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccgaatgcagtgatattgcaaaacgcatggaaggtgagttgcacaatattggcagcggtgtccgtttctccactgctcctaacatcctcacagcagaaagcggattggataccactggcattgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggcccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttttgatgcatagagggaaaaggattgaaccatcatgggcagatgtcaagaaagatctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaatcccacgatagaggcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttttgttcacaccattttcatgagttagtcatgaaagatggtcgcgtgctcgtagtcccatgcagaaaccaagatgaattgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttatgggcaatgagggatacacagactacatgccatccatgaagagattcagaagggaagaggaagaggcaggtgtcctgtggtag

SEQ ID NO: 6475 - RNA, 9876 nt, synthetic construct
  misc_feature 1..9876: note = derived and/or modified CDS sequence (wt) from DENV-2__HM181971__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatcgttctagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccggaaaatttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacgatggagtgctccccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatagattttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggttaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccgaatgcagtgatattgcaaaacgcatggaaggtgagttgcacaatattggcagcggtgtccgtttctccactgctcctaacatcctcacagcagaaagcggattggataccactggcattgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttttgatgcatagagggaaaaggattgaaccatcatgggcagatgtcaagaaagatctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacaggaaaggaaaagttgtgggtctttacggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagattgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtctcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaatcccacgatagaggcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttttgttcacaccattttcatgagttagtcatgaaagatggtcgcgtgctcgtagtcccatgcagaaaccaagatgaattgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttatgggcaatgagggatacacagactacatgccatccatgaagagattcagaagggaagaggaagaggcaggtgtcctgtggtag

SEQ ID NO: 6476 - RNA, 9876 nt, synthetic construct
  misc_feature 1..9876: note = derived and/or modified CDS sequence (wt) from DENV-2__GU131881__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgcaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgtaaaaagaacatggaaggaaaaatcgtacagccagaaaatttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaagctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaaaacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcattgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcattagaacgggattgttagtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagaggaattcttggatattctcagattggagccggagtttacaaagaaggaacattccatacaatgtggcacgtcacacgtggtgctgttctgatgcatagagggaagaggattgaaccatcatgggcagatgtcaagaaagatctaatatcatatggaggaggctggaagctagaaggagaatggaaggaaggagaggaagtccaagttctggcattggaacctggaaaaaatcccagagctgtccaaacgaaacctggaatttttaaaaccaacaccggaaccataggcgctgtatctctggacttttcccctggaacatcaggatctccaattgtcgacagaaaaggaaaagttgtgggtctttacggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagctgagcacaccgggcgagagattgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgacccagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagttaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaactctacaaaggaaatatggaggagccttagtgaggaatccactctcacgaaactctacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacggacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 6477 - RNA, 9876 nt, synthetic construct
  misc_feature 1..9876: note = derived and/or modified CDS sequence (wt) from DENV-2__FJ898461__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaattgataaaaacagaagccaaacaacctgccactctaaggaagtactgtatagaagcaaagctgaccaacacaacaacagaatcgcgttgcccaacacaaggggaacccagcctaaatgaagagcaggacaaaaggttcatctgcaaacactccatggtagatagaggatggggaaatggatgtggattatttggaaagggaggcattgtgacctgtgctatgtttacatgcaaaaagaacatggaaggaaaagtcgtgcagccggaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctaccaggagcggacacacaaggatcaaattggatacagaaggagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccattggccaaatgtttcagacaacagtgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacatcaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcacctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctgagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacgaaacatgcaatactgctagttgtagtatcttttgtgacattgattactgggaacatgtcttttagagacctgggaagagtaatggttatggtaggcgctaccatgacggatgacataggtatgggagtgacttatcttgccctactagcagcttttaaagttagaccaacttttgcagctggactactcttgagaaaactgacctccaaggaattgatgatggccaccataggaatcgcactcctttcccaaagcaccataccagagaccattcttgaactgactgatgcgttagctttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttctccactgctcttaacatcctcacagcagaaagcagattggataccactggcattgacgataaaaggtctcaatccaacagccatttttctaacaactctttcgagaaccagcaagaaaaggagctggccgctaaatgaagctatcatggcagtcgggatggtgagcattttggccagttctctcctaaagaatgatattcccatgacaggtccattagtggctggagggctccttaccgtatgttacgtgctcactggacgatcggccgatttagaactggagagagctgccgatgtaaaatgggaagatcaggcagaaatatcaggaagcagcccaatcctgtcaataacaatatcagaagatggaagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccatacaatgtggcacgtcacacgtggcgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctagacttttcccctggaacgtcaggatctccaattgtcgacagaaaaggaaaagttgtgggcctttacggtaatggtgttgttacaaggagtggagcatatgtaagtgctatagcccagaccgaaaaaagcattgaagacaatccagagatcgaagatgacattttccgaaagaaaagattgaccatcatggaccttcatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccattccctcagagcaatgcaccaatcatggatgaggaaagagaaatccctgagcgttcgtggaattcaggacacgaatgggtcacggattttaagggaaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaatagggagaaatccaaaaaatgaaaatgaccagtacatatacatgggggaacctcttgaaaatgatgaagactgtgcacattggaaagaagctaagatgctcctagataacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaatcaagaataaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaacctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgatagacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgatataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgcaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctagggttcctgaatgaagatcactggttctccagaggcaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggtcttaatactttcaccaatatggaagcccaattaattagacagatggagggagaaggaatcttcaaaagcattcagcacctgacagccacagaagaaatcgctgtacagaactggttagcaagattggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgtgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6478 - RNA, 9876 nt, synthetic construct
  misc_feature 1..9876: note = derived and/or modified CDS sequence (wt) from DENV-2__FJ024473__SS-prME
  source 1..9876: mol_type = other RNA
acagcaggcgtgatcgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagacacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaacatcaaatagagacttcgtggaaggggtttcaggaggaagctgggttgacatagtcttagaacatggaagttgtgtgacgacgatggcgaaaaacaaaccaacattggattttgaactgataaaaacagaagccaaacaacctgccactctgaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcgatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatattctatgtgtacaggaaagtttaaaattgtgaaagaaatagcagaaacacaacatggaacaatagttatcagagtacaatatgaaggggacggttctccatgtaagatcccctttgagataacagacttggaaaaaagacacgtcttaggtcgcctgattacagttaacccaatcgtaatagaaaaagatagcccagtcaacatagaagcagaacctccattcggagatagctacatcattataggagtagagccgggacaattgaaactcaattggtttaagaagggaagttccatcggccaaatgttcgagacaacaatgagaggagcaaagagaatggccattttaggtgacacagcctgggattttggatccctgggaggagtgttcacatctataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatctccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatacttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtaatactgcgaaacgcatggaaggtgagttgcacgatattggcagcggtgtccgtttctccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaaacaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccactagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaaaaaaagattgactatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatacctgagcgttcgtggaattcaggacatgaatgggtcacggattttaaggggaagactgtttggtttgttccaagtataaaagcaggaaatgatatagcagcttgtctcaggaaaaatggaaagaaagtgatacaactcagtaggaaaacttttgactctgagtatgttaagactagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccgttgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagccgcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgttaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctatgcgtgactcaagtattaatgatgaggactacatgggctttgtgtgaggctctaaccttagcgaccgggcccatctccacactgtgggaaggaaatccagggaggttttggaacactaccattgcagtgtcaatggctaacatctttagggggagctacttggccggagctggacttctcttttctatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatctcggttgcggcagagggggctggtcatactattgtgggggactaaagaatgtaagagaagtcaaaggtctaacaaaaggaggaccaggacacgaagaacccatccctatgtcaacatatggatggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatacatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgaggcagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtatgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaacatggaagcccaattaattagacagatggagggagaaggaatcttcaaaagcattcagcacctgacagccacagaagaaatcgctgcacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaatgattggacacaagtgcctttctgttcacaccattttcatgagttagtcatgaaagatggtcgcgtgctcgtagtcccatgtagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6479 - RNA, 9876 nt, synthetic construct
  misc_feature 1..9876: note = derived and/or modified CDS sequence (wt) from DENV-2__FJ024474__SS-prME
  source 1..9876: mol_type = other RNA
acagcaggcgtgatcgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagacacaatcacgtacaagtgtcctctcctcaaacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtggaaggggtttcaggaggaagctgggttgacatagtcttagaacatggaagttgtgtgacgacgatggcgaaaaacaaaccaacattggattttgaactgataaaaacagaagccaaacaacctgccactctgaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacataggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatattctatgtgtacaggaaagtttaaaattgtgaaagaaatagcagaaacacaacatggaacaatagttatcagagtacaatatgaaggggacggttctccgtgtaagatcccctttgagataacagacttggaaaaaagacacgtcttaggtcgcctgattacagttaacccaatcgtaatagaaaaagatagcccagtcaacatagaagcagaacctccattcggagatagctacatcattataggagtagagccgggacaattgaaactcaattggtttaagaagggaagttccatcggccaaatgttcgagacaacaatgagaggagcaaagagaatggccattttaggtgacacagcctgggattttggatccctgggaggagtgttcacatctataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatctccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatacttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtaatactgcgaaacgcatggaaggtgagttgcacgatattggcagcggcgtccgtttctccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttacgtgctcactggacgatcggccgatttggaactggagagggctgccgatgtaaaatgggaagatcaggcagaaatatcaggaagcagcccaatcctgtcaataacaatatcagaagatggcagcatgtcgataaaaaatgaagaggaagaacaaatactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaaaaaaagattgaccatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcttgtctcaggaaaaatggaaagaaagtgatacaactcagtaggaaaacttttgactctgagtatgttaagactagagccaatgattgggactttgtggtcacgactgacatttcagaaatgggtgccaacttcaaagctgagagggttatagaccccagacgttgcatgaaaccagttatactaacacatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccgttgatggtgaataccgtttgagaggagaagcaaggaaaacctttgtggacctaatgagaagaggggacttaccagtctggttggcttacaaagtggcagctgaaggcatcaactacgcagacagaaagtggtgttttgacggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctatgcgtgactcaagtattaatgatgaggactacatgggctttgtgtgaggctctaaccttagcgaccgggcccatctccacactgtgggaaggaaatccagggaggttttggaacactaccattgcagtgtcaatggctaacatctttagggggagctacttggccggagctggacttctcttttctatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatctcggttgcggcagagggggctggtcatactattgtgggggactaaagaatgtaagagaagtcaaaggtctaacaaaaggaggaccaggacacgaagaacccatccctatgtcaacatatggatggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatacatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtatgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgcacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaatgattggacacaagtgcctttctgttcacaccattttcatgagttagtcatgaaagatggtcgcgtgctcgtagtcccatgtagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6480 - RNA, 9876 nt, synthetic construct
  misc_feature 1..9876: note = derived and/or modified CDS sequence (wt) from DENV-2__FJ024475__SS-prME
  source 1..9876: mol_type = other RNA
acagcaggcgtgatcgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagacacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtggaaggggtttcaggaggaagctgggttgacatagtcttagaacatggaagttgtgtgacgacgatggcgaaaaacaaaccaacattggattttgaactgataaaaacagaagccaaacaacctgccactctcaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcgatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatattctatgtgtacaggaaagtttaaaattgtgaaagaaatagcagaaacacaacatggaacaatagttatcagagtacaatatgaaggggacggttctccatgtaagatcccctttgagataacagacttggaaaaaagacacgtcttaggtcgcctgattacagttaacccaatcgtaatagaaaaagatagcccagtcaacatagaagcagaacctccattcggagatagctacatcattataggagtagagccgggacaattgaaactcaattggtttaagaagggaagttccatcggccaaatgttcgagacaacaatgagaggagcaaagagaatggccattttaggtgacacagcctgggattttggatccctgggaggagtgttcacatctataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatctccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatacttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtaatactgcgaaacgcatggaaggtgagttgcacgatattggcagcggtgtccgtttctccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaaacaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccggaaaaaaagattgactatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcttgtctcaggaaaaatggaaagaaagtgatacaactcagtaggaaaacttttgactctgagtatgttaagactagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccgttgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagccgcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctatgactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctatgcgtgactcaagtattaatgatgaggactacatgggctttgtgtgaggctctaaccttagcgaccgggcccatctccacactgtgggaaggaaatccagggaggttttggaacactaccattgcagtgtcaatggctaacatctttagggggagctacttggccggagctggacttctcttttctatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatctcggttgcggcagagggggctggtcatactattgtgggggactaaagaatgtaagagaagtcaaaggtctaacaaaaggaggaccaggacacgaagaacccatccctatgtcaacatatggatggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatacatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtatgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatattatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgcacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaatgattggacacaagtgcctttctgttcacaccattttcatgagttagtcatgaaagatggtcgcgtgctcgtagtcccatgtagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6481 - RNA, 9867 nt, synthetic construct
  misc_feature 1..9867: note = derived and/or modified CDS sequence (wt) from DENV-2__FJ182012__SS-prME
  source 1..9867: mol_type = other RNA
acagcaggcgtgatcgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagacacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtggaaggggtttcaggaggaagctgggttgacatagtcttagaacatggaagttgtgtgacgacgatggcgaaaaacaaaccaacattggattttgaactgataaaaacagaagccaaacaacctgccactctgaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacaacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatattctatgtgtacaggaaagtttaaaattgtgaaagaaatagcagaaacacaacatggaacaatagttatcagagtacaatatgaaggggacggttctccatgtaagatcccctttgagataacagacttggaaaaaagacacgtcttaggtcgcctgattacagttaacccaatcgtaatagaaaaagatagcccagtcaacatagaagcagaacctccattcggagatagctacatcattataggagtagagccgggacaattgaaactcaattggtttaagaagggaagttccatcggccaaatgttcgagacaacaatgagaggagcaaagagaatggccattttaggtgacacagcctgggattttggatccctgggaggagtgttcacatctataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatctccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatacttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtaatactgcgaaacgcatggaaggtgagttgcacgatattggcagcggtgtccgtttctccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttacgtgctcactggacgatcggccgatttggaactggagagggctgccgatgtaaaatgggaagatcaggcagaaatatcaggaagcagcccaatcctgtcaataacaatatcagaagatggcagcatgtcgataaaaaatgaagaggaagaacaaatactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaaaaaaagattgaccatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcttgtctcaggaaaaatggaaagaaagtgatacaactcagtaggaaaacttttgactctgagtatgttaagactagagccaatgattgggactttgtggtcacgactgacatttcagaaatgggtgccaacttcaaagctgagagggttatagaccccagacgttgcatgaaaccagttatactaacacatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccgttgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttctttcattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctatgcgtgactcaagtattaatgatgaggactacatgggctttgtgtgaggctctaaccttagcgaccgggcccatctccacactgtgggaaggaaatccagggaggttttggaacactaccattgcagtgtcaatggctaacatctttagggggagctacttggccggagctggacttctcttttctatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatctcggttgcggcagagggggctggtcatactattgtgggggactaaagaatgtaagagaagtcaaaggtctaacaaaaggaggaccaggacacgaagaacccatccctatgtcaacatatggatggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatacatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtatgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgcacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaatgattggacacaagtgcctttctgttcacaccattttcatgagttagtcatgaaagatggtcgcgtgctcgtagtcccatgtagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6482 - RNA, 9876 nt, synthetic construct
  misc_feature 1..9876: note = derived and/or modified CDS sequence (wt) from DENV-2__EU854293__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctgtttaaaacaggggatggtgtgaacatgtgtaccctcatggccatggaccttggtgaattgtgtgaagatacaatcacgtacaagtgtcctcttctcaggcagaatgaaccagaagacatagattgttggtgcaactctacgtccacatgggtaacttatgggacgtgtaccaccacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccataatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacagaagccaaacaatctgccactctaaggaagtactgtatagaggcaaagctgaccaacacaacaacagaatctcgctgcccaacacaaggagaacccagcctaaatgaagagcaggacaaaaggttcgtctgcaaacactccatggtggacagaggatggggaaatggatgtggattatttggaaaaggaggcattgtgacctgtgctatgttcacatgcaaaaagaacatgaaaggaaaagtcgtgcaaccagaaaacttggaatacaccattgtgataacacctcactcaggggaagagcatgcagtcggaaatgacacaggaaaacatggcaaggaaatcaaaataacaccacagagttccatcacagaagcagagttgacaggctatggcactgtcacgatggagtgctctccgagaacgggcctcgacttcaatgagatggtgttgctgcaaatggaaaataaagcttggctggtgcacaggcaatggttcctagacctgccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggaaacttactgttcacaggacatctcaagtgcaggctgaggatggacaaactacagctcaaaggaatgtcatactctatgtgcacaggaaagtttaaagttgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacagaaaaagatagcccagtcaacatagaggcagaacctccattcggagacagctacatcatcataggagtagagccgggacaattgaagctcaactggtttaagaaaggaagttctatcggccaaatgtttgagacaacaatgaggggagcgaagagaatggccattttaggtgacacagcttgggattttggatccctgggaggagtgtttacatctataggaaaggctctccaccaagttttcggagcaatctatggggctgccttcagtggggtctcatggactatgaaaatcctcataggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaagtgtggcagtgggattttcatcacagacaacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcggccccagcccactgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaaaagcaggatgtattctgcgactcaaaactcatgtcagcggccataaaagacaacagagccgtccatgccgatatgggttattggatagaaagtgcactcaatgacacatggaagatagagaaagcctctttcatcgaagttaaaagctgccactggccaaagtcacacaccctctggagtaatgaagtgctagaaagtgagatgataattccaaagaatttcgctggaccagtgtcacaacacaactacagaccaggctaccatacacaaacagcaggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccataggaatcgtactcctctcccagagcaccataccagagaccattcttgaactgactgatgcgttagccttgggcatgatggtccttaaaatggtgagaaaaatggaaaagtatcaattggcagtgactatcatggctatcttgtgcgtcccaaatgcagtgatattacaaaacgcatggaaagtgagttgcacaatattggcagtggtgtccgtttccccactgttcttaacatcctcacagcagaaagcggattggataccattagcattgacgatcaagggtctcaatccaacagctatttttctaacaaccctttcaagaaccaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaatactgaccatactcattagaacaggattgctggtgatctcaggactttttcctgtatcaatgccaatcacggcagcagcatggtacctgtgggaagtgaagaaacaacgggctggagtattgtgggatgtcccttcacccccacccgtgggaaaggctgaactggaagatggagcctatagaatcaagcaaaaagggattcttggatattcccagatcggagccggagtttacaaagaaggaacattccatacaatgtggcatgtcacacgcggcgctgttctaatgcataaaggaaagaggattgaaccatcatgggcggacgttaagaaagacctaatatcatatggaggaggctggaagctagaaggagaatggaaggaaggagaagaagtccaggtcttggcattggagcctggaaaaaatccaagagccgtccaaacaaaacctggtcttttcaaaaccaacgccggaaccataggtgccgtatctctggacttttctcctggaacctcaggatctccaatcatcgacaaaaaaggaaaagttgtgggtctttatggtaatggtgttgttacaaggagtggagcatatgtgagtgctatagcccagactgaaaaaagtattgaagacaatccagagatcgaagatgacatttttcgaaagagaaaattgaccatcatggacctccacccaggagcgggaaagacgaagagataccttccggccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataaaagcaggaaatgatatagcagcttgcctgagaaaaaatggaaagaaagtgatacaactcagtaggaagacctttgattctgagtatgtcaagactagaaccaatgattgggacttcgtggtcacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagctgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaggatctactctgacccactggcgctaaaggaattcaaggagtttgcagctggaagaaagtccctgaccctgaacctaatcacagaaatgggtaggcttccaactttcatgactcagaaggcaagagacgcactggacaacttagcagtgctgcacacggctgaagcaggtggaagggcgtacaatcatgctctcagtgaactgccggagaccctggagacattgcttttactgacacttctggctacagtcacgggaggaatctttttattcttgatgagcggaaggggtatagggaagatgaccctgggaatgtgctgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcattacaacccagcaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaagcaaccagagaagctcagaaaagagcagcagcgggcatcatgaaaaacccaactgtcgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacatttttagagggagttacttggccggagctggacttctcttttccatcatgaagaacacaaccaacacgagaaggggaactggcaacataggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctaacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtcctcaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgagacacaagaaagccacttacgagccagatgtagacctcggaagcggaacccgcaacatcggaattgaaagtgagataccaaacctagacataatcgggaaaagaatagaaaaaataaaacaagagcatgaaacatcatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtgacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtataacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccttgagtggagtggaaggagaagggctgcacaagctaggttacattttaagagacgtgagcaagaaagagggaggagcaatgtatgccgatgacaccgcaggatgggacacaagaatcacactagaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagtcttcaaaagcattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtacttgtagttccatgcagaaaccaagatgaactgattggtagagcccgaatttcccaaggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6483 - RNA, 9876 nt, synthetic construct
  misc_feature 1..9876: note = derived and/or modified CDS sequence (wt) from DENV-2__EU854294__SS-prME
  source 1..9876: mol_type = other RNA
acagcaggcgtgatcgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagacacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtggaaggggtttcaggaggaagctgggttgacatagtcttagaacatggaagttgtgtgacgacgatggcgaaaaacaaaccaacattggattttgaactgataaaaacagaagccaaacaacctgccactctgaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatattctatgtgtacaggaaagtttaaaattgtgaaagaaatagcagaaacacaacatggaacaatagttatcagagtacaatatgaaggggacggttctccatgtaagatcccctttgagataacagacttggaaaaaagacacgtcttaggtcgcctgattacagttaacccaatcgtaatagaaaaagatagcccagtcaacatagaagcagaacctccattcggagatagctacatcattataggagtagagccgggacaattgaaactcaattggtttaagaagggaagttccatcggccaaatgttcgagacaacaatgagaggagcaaagagaatggccattttaggtgacacagcctgggattttggatccctgggaggagtgttcacatctataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatctccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatacttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtaatactgcgaaacgcatggaaggtgagttgcacgatattggcagcggtgtccgtttctccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaaaaaaagattgaccatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcttgtctcaggaaaaatggaaagaaagtgatacaactcagtaggaaaacttttgactctgagtatgttaagactagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccgttgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctatgcgtgactcaagtattaatgatgaggactacatgggctttgtgtgaggctctaaccttagcgaccgggcccatctccacactgtgggaaggaaatccagggaggttttggaacactaccattgcagtgtcaatggctaacatctttagggggagctacttggccggagctggacttctcttttctatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatctcggttgcggcagagggggctggtcatactattgtgggggactaaagaatgtaagagaagtcaaaggtctaacaaaaggaggaccaggacacgaagaacccatccctatgtcaacatatggatggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatacatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtatgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgcacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaatgattggacacaagtgcctttctgttcacaccattttcatgagttagtcatgaaagatggtcgcgtgctcgtagtcccatgtagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6484 - RNA, 9876 nt, synthetic construct
  misc_feature 1..9876: note = derived and/or modified CDS sequence (wt) from DENV-2__FJ024477__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacctacaagtgtcctctcctcagacaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgatatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggccttgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcctgatcacagttaacccaatcgtaacagaaaaagatagcccagtcaacatagaagcagaacctccattcggggacagctacatcatcataggagtagagccgggacaattgaaactcaattggtttaagaagggaagttccatcggccaaatgttcgagacaacaatgagaggagcaaagagaatggctattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtactggtgggagtcgtgacactgtacctgggagctatggtgcaggctgatagtggctgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagcaacaagattggagaacctgatgtggaaacaaataacaccagaattgaatcatattctatcagaaaatgaggtaaagttgaccattatgacaggagacattaaaggaatcatgcaagcaggaaaacgatccttgcggccccagcccactgagctgaagtactcatggaaaacatggggaaaggcgaaaatgctctccacagagtctcacaatcagacctttcttattgatggccctgaaacagcagaatgccccaatacaaacagagcttggaactcactggaagttgaagactatggttttggagtttttactaccaatatatggctaaaattgagagaaaaacaggatgtattttgtgactcaaaactcatgtcagcggccatcaaagacaacagagccgttcacgccgatatgggttattggatagaaagcgcactcaatgacacatggaagatggagaaagcctccttcattgaagttaaaagctgccattggccaaagtcacacaccctctggagcaatggagtattagaaagtgagatgataattccaaaaaactttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactctttggtcacagccggacatgggcagattgacaacttttcactaggagtcttgggaatggcactgttcctggaagaaatgctcaggacccgagtaggaacgaaacatgcaatactgctagctgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaagaattaatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccgaatgcagtgatactgcaaaacgcatggaaggtgagttgcacaatattggcagtggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggctgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaggatggagcctacagaattaagcaaagagggattcttggatattctcagattggagccggagtttacaaagaaggaacattccatacaatgtggcacgtcacacgtggtgctgtcctgatgcatagagggaagaggattgaaccatcatgggcagatgtcaagaaagacctaatatcatatggaggaggctggaagctagaaggagagtggaaggaaggagaggaagtccaagtcctggcattggaacctgggaaaaatccaagagccgtccaaacaaaacctggaattttcaaaaccaacaccggaaccataggcgccgtatctctggacttttcccctggaacgtcaggatctccaattgtcgacagaaaaggaaaggttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcaaagccgaacacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaatttcaaggctgagagggttatagaccccagacgttgcatgaaaccagtcatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagactctggagacactgcttctactgacactcctggcaacagtcacaggaggaatcttcttattcttaatgagcggaaaaggtatagggaagatgaccctgggaatgtgttgcataatcacggctagtgtcctcctatggtatgcacagatacaaccacactggatagcagcttcaataatactggagttttttctcatagttttgctcattccagagccagaaaaacagagaacaccccaagacaaccaattgacctacgttgtcatagccatcctcacagtggtggctgcaaccatggcaaacgagatgggtttcctggaaaaaaccaagaaagacctcggattgggaagcattacaacccaggaatctgagagcaacatcctggacatagatctacgccctgcatcagcatggacgctgtatgccgtggccacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattataggcccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccctagcgaccgggcccatctccacactgtgggaaggaaatccagggaggttttggaacaccaccatcgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcgctgggaaaaagtgaatttcagatctacaagaaaagtggaatccaggaagtggatagaaccctagcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtagacacgagaacccaagaaccgaaggaaggcacgaagaagctgatgaaaatcacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaagcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagctgaggccatattcaaattaacgtaccaaaataaggtggtgcgtgtgcaaagaccaacaccaagaggcacagtaatggatatcatatcgagaagagaccaaagaggcagtgggcaagtcggcacctatggccttaatactttcaccaatatggaagcccaattaatcagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcttgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgttctgtggtag

SEQ ID NO: 6485 - RNA, 9876 nt, synthetic construct
  misc_feature 1..9876: note = derived and/or modified CDS sequence (wt) from DENV-2__GQ868552__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagacacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggaaacacgaactgaaacatggatgtcatcagaaggggcctggaaacatgttcagagaattgaaacctggatcttgagacatccaggctttgccataatggcagcaatcctggcatacaccataggaacgacacatttccaaagggccttgattttcatcttattgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaacaaaccaacactggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgtttacatgcaaaaagaacatggaaggaaaagtcgtgctgccagaaaatctggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgttgctgcagatggaagagaaagcttggctggtgcacaggcaatggttcttagacctgccgttaccatggctacctggagcggacacacaaggatcaaattggatacagaaagagacattggtcacttttaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactgcagctcaaaggaatgtcatactctatgtgtacaggaaagtttaaaattgtgaaagaaatagcagaaacacaacatggaacaatagttatcagagtacaatatgaaggggacggctctccatgtaagatcccttttgagataatggatttggaaaaaagacacgtcttgggtcgcctgattacagtcaacccaatcgtaacagaaaaagatagcccagtcaacatagaagcagaacctccattcggagacagttacatcatcataggagtagagccgggacaattgaaactcaattggtttaagaagggaagttccatcggtcaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtactggtgggagtcgtgacactgtacctgggagctatggtgcaggctgacagtggttgcgttgtgagctggaaaaacaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacatcctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctttccacagagtctcacaatcagacctttcttattgatggccctgaaacagcagaatgccccaacacaaacagagcttggaactcgctggaagttgaagactatggttttggagtctttaccaccaatatatggctaaaactgagagaaaaacaggatgtgttttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagtaatggagtattggaaagtgagatgataattccaaaaaattttgctggaccagtgtcacaacacaactacagaccaggctaccatacacaaacagcaggaccttggcatctaggtaagcttgagatggacttcgatttctgcgaaggaaccacagtggtggtgaccgaggactgtggaaatagaggaccctctttaagaacgaccactgcctctggaaaactcataacagaatggtgctgccgatcttgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatagcactgttcctggaagagatgctcaggacccgagtaggaacgaaacatgcaatactgctagttgcaatatcttttgtgacattgattactgggaacatgtcttttagagacctgggaagagtgatggttatggtgggcgctaccatgacggatgacataggtatgggagtgacttaccttgccctattagcagctttcaaagttagaccaactttcgcagctggactactcttgagaaggctgacctccaaggaactaatgatggccaccataggaatcgcacttctttcccaaagcaccataccagagaccattctagaactgactgatgcgttagccttgggcatgatggtcctcaaaatagtgagaaatatggaaaagtaccaattggcagtgactatcatggctatctcgtgtgtcccaaatgcagtgatactgctaaacgcatggaaggtgagttgcacaatattggcagcggtatccgtttctccattgctcttaacatcctcacagcagaaagcggactggataccactggcactgacgataaaaggtctcaatccgacagccatctttctaacaactctttcgagaaccagcaagaaaaggagctggccgctaaatgaagctgtcatggcagtcgggatggtgagcattttagccagttctctcctaaagaatgacattcccatgacgggtccattggtggctggagggctccttactgtgtgttacgtgctcactggacgatcggccgatttggaactggagagagccgccgatgtaaaatgggaagatcacgcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaattacggcagcagcatggtacctatgggaagtgaagaaacaacgggctggagtattgtgggacgtcccttcacctccaccagtggaaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagttggaaggagaatggaaagaaggagaggaagtccaagtcctggcattggaacctggaaaaaatccaagagccgtccaaacgaaacctggacttttcaaaaccaacaccggaaccataggcgccgtatctctggacttttcccctggaacctcaggatctccaattgtcgacagaaaaggaaaagttgtgggtctttatggtaatggtgttgtcacaaggagtggagcatatgtgagtgctatagcccagaccgaaaaaagcattgaaaacaatccagagatcgaagatgacattttccgaaagaaaagactgaccattatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacactgggcgggagatcgtggacctaatgtgtcatgccacatttactatgaggctgctatcaccagtcagagtgccaaattacaatctgatcattatggacgaagcccacttcacagatccagcaagtatagcagctagaggatatatttcaactcgagtagaaatgggtgaagcagctgggattttcatgacagccactcctccgggaagtagagacccatttcctcagagcaatgcaccaatcatggatgaggaaagagaaatccctgagcgctcgtggaattcaggacatgaatgggtcacggatttcaaagggaagactgtttggtttgttccaagtataaaagcaggaaatgacatagcagcttgccttagaaaaaatggaaagaaagtgatacaactcagtaggaagacttttgactctgagtatgttaagactagagccaatgattgggattttgtggtcacaactgacatttcagaaatgggtgccaacttcagggctgagagggttatagatcccagacgttgcatgaaaccagtcatactaacagatggcgaagagcgggtgatcttggcaggacctatgccagtgacccactctagtgcagcacaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgtttgaaccagagcgtgaaaaggtggatgccattgatggtgaataccgtttgagaggagaagcaaggaaaacctttgtggacctaatgagaagaggggacttaccagtatggttggcctacagagtggcagctgaaggtatcaactacgcagacagaaggtggtgttttgatggaattaagaacaaccaaatactggaagaaaacgtggaagtggaaatctggacgaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttatctgtgctgcatacggctgaggcaggtggaagggcgtacaatcatgctctcagtgaactgccagagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgtagtcatagccatcctcacagtagtggccgcaaccatggcaaatgagatgggtttcctggaaaaaaccaagaaagacctcggattgggaagcattacaacccaggaacctgagagtaacatcctggacatagatttacgtcctgcatcagcatggacgttgtatgccgtggctacaacatttgttacaccaatgttgagacatagcattgaaaattcctcagtgaatgtctccctaacagccattgctaatcaagctacagtgctaatgggtcttggaaaaggatggccattgtcaaagatggacatcggagttcccctccttgccattggatgctattcacaagtcaaccctataactctcacagcagcccttcttttattggtagcacattatgccattatagggccaggacttcaggcaaaagcaactagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagctaccgggcccatctccacactgtgggaaggaaatccagggaggttttggaacactaccattgcagtgtcaatggctaacatctttagggggagctacttggctggagctggacttctcttctccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttggcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactactgcgggggactaaagaatgtgagagaagtcaaaggcctgacaaaaggaggaccaggacacgaagaacccatccccatgtcaacatatgggtggaatctagtgcgtctgcaaagtggggttgacgttttcttcaccccgccagaaaagtgtgatacattgttatgtgacataggggagtcgtcaccaaatcccacgatagaagcaggacgaacactcagagtcctcaacttagtggaaaattggttgaacaacaacacccaattctgcataaaggttctcaacccatatatgccctcagtcatagagaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaaacaagagcatgaaacatcatggcactatgaccaagaccacccatacaaaacgtgggcttaccatggcagctatgaaacaaaacaaactggatcagcatcatctatggtaaacggagtggtcagactgctgacaaaaccttgggacgtcgtccctatggtgacacagatggcaatgacagacacgactccttttggacaacaacgcgttttcaaagagaaagtggacacgagaacccaagaaccgaaggaaggcacaaagaaattgatgaaaatcacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaagaagggggagcaatgtacgccgatgatacagcaggatgggacacaagaatcacactagaagacttaaaaaatgaagaaatggtaacaaaccatatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagcgggcaagtcggcacctatggccttaatactttcactaacatggaagctcaattaattagacagatggagggagaaggaatcttcaaaagcattcagcacctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgactggacacaagtgcctttctgttcacatcattttcacgagttagtcatgaaagatggtcgcgtgctcgtagtcccatgcagaaaccaagatgaactgattggcagagcccgaatttctcaaggagccgggtggtctttaaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcacgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatctcttataggcaatgaggaatacacagactacatgccatccatgaagagattcagaagggaagaggaagaggcaggtgtcctgtggtag

SEQ ID NO: 6486 - RNA, 9876 nt, synthetic construct
  misc_feature 1..9876: note = derived and/or modified CDS sequence (wt) from DENV-2__GQ868553__SS-prME
  source 1..9876: mol_type = other RNA
acagcaggcgtgattgttatgttgattccgacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaaaaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtactggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaagtaacaccagaattgaatcatattctatcagaaaatgaggtaaagttgaccattatgacaggagacattaaaggaatcatgcaggcaggaaaacgatccttgcggccccagcccactgagctgaagtattcatggaaaacatggggaaaggcgaaaatgctctccacagagtctcacaatcagacctttctcattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaactttgccgggccggtgtcacaacacaactacagaccaggctaccatacacaaacagtaggaccttggcatctaggtaaacttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgagtaggaacgaaacatgcaatactgctagttgcagtatcatttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccatttttgaactgactgatgcgttagccttgggcatgatggtcctcaaaatagtgagaaatatggaaaaataccaattggcagtgactatcatggctatttcgtgtgtcccaaatgcagtgatactgcaaaatgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaatactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccatacaatgtggcacgtcacacgtggtgctgttctgatgcatagaggaaagaggattgaaccatcatgggcagatgtcaagaaagacctaatatcatatggaggaggctggaagctagaaggagaatggaaggaaggagaggaagtccaagtcctggcattggaacctgggaaaaatccaagagccgtccaaacgaaacctggaattttcagaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaactccagccatcaaagccgagcacaccgggcgggagatcgtggacctaatgtgtcatgccacatttaccatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgacatagcagcttgtcttaggaaaaatggaaagaaagtgatacaactcagtaggaagacttttgactctgaatatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacaaatacaaccacactggatagcagcctcaataatactggagttttttctcatagttttgctcatcccagaaccagaaaaacagagaacaccccaagacaaccaattgacctacgtagtcatagccatcctcacagtggtggccgcaaccatggcaaacgagatgggtttcctggaaaaaaccaagaaagacctcggattgggaagcattacaacccaggaatctgagagcaacatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgcttctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcagatctacaagaaaagtggaatccaggaagtggatagaaccctagcaaaagaaggcattaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataatacccaattttgcataaaggtcctcaacccatatatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaggaaggcacgaagaagctgatgaaaatcacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgcacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccgtggatggaagacaaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatctatgaagagattcagaagggaagaggaagaggcaggtgtcctgtggtag

SEQ ID NO: 6487 - RNA, 9876 nt, synthetic construct
  misc_feature 1..9876: note = derived and/or modified CDS sequence (wt) from DENV-2__GQ868554__SS-prME
  source 1..9876: mol_type = other RNA
acagcaggcgtgatcgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagacacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgttgctccttcaatgacaatgcgctgcataggaatatcaaatagagacttcgtggaaggggtttcaggaggaagctgggttgacatagtcttagaacatggaagttgtgtgacgacgatggcgaaaaacaaaccaacattggattttgaactgataaaaacagaagccaaacaacctgccactctgaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagagtacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccattttaggtgacacagcctgggattttggatccctgggaggagtgttcacatctataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagtagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgttccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaaaaaaagattgaccatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcttgtctcaggaaaaatggaaagaaagtgatacaactcagtaggaagacttttgactctgagtatgttaagactagagccaatgattgggactttgtggtcacgactgacatttcagaaatgggtgccaacttcaaagctgagagggttatagaccccagacgttgcatgaaaccagttatattaacagatggcgaagagcgggtgatcttggcaggacctatgccagtgacccactctagtgcagcgcaaagaagagggagaataggaagaaatccaaaaaatgaaaacgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaaccttcgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcttggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtttccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccatcatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctatgcgtgactcaagtattaatgatgaggactacatgggctttgtgtgaggctctaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatctcggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggctatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaatgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6488 - RNA, 9876 nt, synthetic construct
  misc_feature 1..9876: note = derived and/or modified CDS sequence (wt) from DENV-2__GQ868555__SS-prME
  source 1..9876: mol_type = other RNA
acagcaggcgtgattgttatgttgattccaacagcgatagcgttccatttaaccacacgcaatggagaaccacacatgatcgttggtaggcaggagaaagggaaaagtcttctgttcaaaacagaggatggtgttaacatgtgtaccctcatggccatagacctcggtgaattgtgtgaagatacaatcacgtacaagtgtcctctcctcagacaaaatgaaccagaagacatagattgttggtgcaactccacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtggaaggggtttcaggaggaagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatgggggaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggtaatgacacaggaaaacacggcaaggaaatcaaaataacaccacagagttccatcacagaagcagaactgacaggctatggcactgtcacgatggagtgctctccgagaacgggcctcgacttcaatgagatggtgctgctgcagatggaagacaaggcttggctggtgcacaggcaatggttcctagacctgccgttgccatggctacctggagctgacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaagaaatagcagaaacacaacatggaacaatagttatcagagtacaatatgaaggggacgggtctccatgtaagatcccttttgagataacagacttggaaaaaagacatgtcttaggtcgcctgattacagttaacccaatcgtaacagaaaaagatagcccagtcaacatagaagcagaacctccattcggagacagctacattatcataggagtagagccgggacaactgaaactcaattggtttaagaagggaagttccatcggccaaatgttcgagacaacaatgagaggagcaaagagaatggccattttaggtgacacagcctgggattttggatccctgggaggagtgttcacatctataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggagtcgtgacactatacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcgaaaatgctctccacagagtctcacaatcagacctttctcattgatggccctgaaacagcagaatgccccaacacaaatagagcctggaactcgctggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggcaagcttgagatggactttgatctctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggcccattagtggctggagggctccttaccgtatgttacgtgctcactggacgatcggccgatttggaactggagagagctgccgaggtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggaaggagcctacagaatcaagcaaagagggattcttggatattctcagattggagccggagtttacaaagagggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcttggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggactcccaataagataccaaaccccagccatcaaagccgagcatactgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgacatagcagcttgtctcaggaaaaatggaaagaaagtgatacaactcagtaggaagacttttgactctgagtatgttaagactagagccaatgattgggactttgtggtcacgactgacatttcagaaatgggtgccaacttcaaagctgagagggtaatagaccccagacgttgcatgaaaccagttatactaacagatggcgaagagcgggtgatcttggcgggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatatattctgacccactggcactaaaagaatttaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcctattcttaatgagcggaaaaggtatagggaagatgaccctgggaatgtgttgcataatcacggccagtgtcctcctatggtatgcacagatacaaccacactggatagcagcttcaataatactggagttttttctcatagtcttgcttattccagaaccagaaaaacagagaacaccccaagacaaccaattgacctacgttgtcatagccatcctcacagtggtggctgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccgttgtcaaagatggacatcggagttcccctccttgccatcggatgctactcacaagtcaaccctataactctcacagcagctcttcttttattggtagcacattatgccattatagggccaggactccaagcaaaagcaaccagagaagcacagaaaagagcagcagcaggcatcatgaaaaacccaacagtcgatggaataacagtgattgacctagaaccaataccctatgatccaaaatttgaaaagcagttaggacaagtaatgctcctaatcctatgcgtgacccaagtattaatgatgaggactacatgggctttgtgtgaggctctaaccttagcgaccgggcccatctccacattgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactgaagaatgtaagagaagtcaaaggcctaacaaaaggaggaccaggacacgaagaacccatccctatgtcaacatatgggtggaatttagtgcgtctgcaaagcggagttgacgttttcttcaccccgccagaaaaatgtgatacattgttgtgtgacataggggagtcgtcaccaaatcctacgatagaagcaggacgaacactcagagtcctcaacttagtagaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggtagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgaaaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggagagttcggcaaggcaaaaggcagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatagaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgatatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcagcagtcccgtcacattgggttccaacaagtcgaacaacctggtccatacatgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgatagggctaacaagcagggctacctgggcgaagaacatccagacagcaataaatcaagtcagatccctcataggcaatgaggaatacacagactacatgccatccatgaagagattcagaagggaagaggaagaggcaggtgtcctgtggtag

SEQ ID NO: 6489 - RNA, 9876 nt, synthetic construct
  misc_feature 1..9876: note = derived and/or modified CDS sequence (wt) from DENV-2__GQ868556__SS-prME
  source 1..9876: mol_type = other RNA
acagcaggcgtgatcgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcttggcatacaccataggaacgacacatttccaaagggccttgattttcatcttactgacagctgtcgctccttcaatgacaatgcgctgcataggaatatcaaatagagacttcgtggaaggggtttcaggagggagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagagtacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccattttaggtgacacagcctgggattttggatccctgggaggagtgttcacatctataggaaaggctctccaccaagttttcggagcaatctacggggctgcttttagtggggtctcatggactatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcaccgccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagtaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggtgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccggaaaaaaagattgaccatcatggacctccatccaggagcaggaaagacaaaaagataccttccagccatagtcagagaagccataaaacgtggcttaagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccactttacagacccagcaagtatagcagctagaggatacatttcaactcgagtagagatgggtgaagcagccgggattttcatgacagccactcctccgggaagtagagacccatttcctcagagcaatgcaccaataatggatgaggaaagggaaatccctgagcgttcgtggaattcaggacatgaatgggtcacggattttaaggggaagactgtttggtttgttccaagtataaaagcaggaaatgatatagcagcttgtctcaggaaaaatggaaagaaagtgatacaactcagtaggaaaacttttgactctgagtatgttaagactagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaattacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcacacggctgaggcaggtggaagggcgtacaatcatgctctcagtgaactgccggagaccctggagacactgcttctactgacacttctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctatgcgtgactcaagtattaatgatgaggactacatgggctttgtgtgaggctctaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatctcggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaattagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaatgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcctacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacctgggaaaaagagaagaccaatggtgcggctcattgattgggctaacaagcagggctacctgggcgaagaacatccagacagcaataaatcaagtcagatcccttataggcaatgaggaatacacagactacatgccatccatgaaaagattcagaagggaagaggaagaggcaggtgtcctgtggtag

SEQ ID NO: 6490 - RNA, 9876 nt, synthetic construct
  misc_feature 1..9876: note = derived and/or modified CDS sequence (wt) from DENV-2__GQ868557__SS-prME
  source 1..9876: mol_type = other RNA
acagcaggcgtgattgttatgttgattccaacagcgatagcgttccatttaaccacacgcaatggagaaccacacatgatcgttggtaggcaggagaaagggaaaagtcttctgttcaaaacagaggatggtgttaacatgtgtaccctcatggccatagacctcggtgaattgtgtgaagatacaatcacgtacaagtgtcctctcctcagacaaaatgaaccagaagacatagattgttggtgcaactccacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtggaaggggtttcaggaggaagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatgggggaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggtaatgacacaggaaaacacggcaaggaaatcaaaataacaccacagagttccatcacagaagcagaactgacaggctatggcactgtcacgatggagtgctctccgagaacgggcctcgacttcaatgagatggtgctgctgcagatggaagacaaggcttggctggtgcacaggcaatggttcctagacctgccgttgccatggctacctggagctgacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaagaaatagcagaaacacaacatggaacaatagttatcagagtacaatatgaaggggacgggtctccatgtaagatcccttttgagataacagacttggaaaaaagacatgtcttaggtcgcctgattacagttaacccaatcgtaacagaaaaagatagcccagtcaacatagaagcagaacctccattcggagacagctacattatcataggagtagagccgggacaactgaaactcaattggtttaagaagggaagttccatcggccaaatgttcgagacaacaatgagaggagcaaagagaatggccattttaggtgacacagcctgggattttggatccctgggaggagtgttcacatctataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggagtcgtgacactatacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagctgaccattatgacaggagacactaaaggaatcatgcaggcaggaaaacgatccttgcggccccagcccactgagctgaagtactcatggaaaacatggggaaaggcgaaaatgctctccacagagtctcacaatcagacctttctcattgatggccctgaaacagcagaatgccccaacacaaatagagcctggaactcgctggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggcaagcttgagatggactttgatctctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggcccattagtggctggagggctccttaccgtatgttacgtgctcactggacgatcggccgatttggaactggagagagctgccgaggtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagagggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggactcccaataagataccaaaccccagccatcaaagccgagcatactgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacagattttaaggggaagactgtttggtttgttccaagtataaaagcaggaaatgacatagcagcttgtctcaggaaaaatggaaagaaagtgatacaactcagtaggaagacttttgactctgagtatgttaagactagagccaatgattgggactttgtggtcacgactgacatttcagaaatgggtgccaacttcaaagctgagagggtaatagaccccagacgttgcatgaaaccagttatactaacagatggcgaagagcgggtgatcttggcgggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatatattctgacccactggcactaaaagaattcaaggaatttgcagctggaagaaaatctttgaccctgaacctaatcacagaaatgggcaggcttccaactttcatgacgcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcctattcttaatgagcggaaaaggtatagggaagatgaccctgggaatgtgttgcataatcacggccagtgtcctcctatggtatgcacagatacaaccacactggatagcagcttcaataatactggagttttttctcatagtcttgcttattccagaaccagaaaaacagagaacaccccaagacaaccaattgacctacgttgtcatagccatcctcacagtggtggctgcaaccatggcaaacgagatgggtttcctggaaaaaaccaagaaagacctcggattgggaagcattacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccgttgtcaaagatggacatcggagttcccctccttgccatcggatgctactcacaagtcaaccctataactctcacagcagctcttcttttattggtagcacattatgccattatagggccaggactccaagcaaaagcaaccagagaagcacagaaaagagcagcagcaggcatcatgaaaaacccaacagtcgatggaataacagtgattgacctagaaccaataccctatgatccaaaatttgaaaagcagttaggacaagtaatgctcctaatcctatgcgtgacccaagtattaatgatgaggactacatgggctttgtgtgaggctctaaccttagcgaccgggcccatctccacattgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactgaagaatgtaagagaagtcaaaggcctaacaaaaggaggaccaggacacgaagaacccatccctatgtcaacatatgggtggaatttagtgcgtctgcaaagcggagttgacgtttttttcaccccgccagaaaaatgtgatacattgttgtgtgacataggggagtcgtcaccaaatcctacgatagaagcaggacgaacactcagagtcctcaacttagtagaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggtagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgaaaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggagagttcggcaaggcaaaaggcagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaaacgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcagcagtcccgtcacattgggttccaacaagtcgaacaacctggtccatacatgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgatagggctaacaagcagggctacctgggcgaagaacatccagacagcaataaatcaagtcagatccctcataggcaatgaggaatacacagactacatgccatccatgaagagattcagaagggaagaggaagaggcaggtgtcctgtggtag

SEQ ID NO: 6491 - RNA, 9876 nt, synthetic construct
  misc_feature 1..9876: note = derived and/or modified CDS sequence (wt) from DENV-2__GU131947__SS-prME
  source 1..9876: mol_type = other RNA
acagcaggcgtgattgttatgttgattccaacagcgatagcgttccacttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactccacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtggaaggggtttcaggaggaagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatgggggaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggtaatgacacaggaaaacacggcaaggaaatcaaaataacaccacagagttccatcacagaagcagaactgacaggctatggcactgtcacgatggagtgctctccaagaacgggcctcgacttcaatgagatggtgctgctgcagatggaagacaaagcttggctggtgcacaggcaatggttcctagacctgccgttgccatggctacctggagctgacacacaaggatcaaattggatacagaaagagacattggtcactttcaaaaatccccacgcgaagaaacaggatgtcgttgtcctagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaagaaatagcagaaacacaacatggaacaatagttatcagagtacaatatgaaggggatggttctccatgtaagatcccttttgagataacagacttggaaaaaagacacgtcttaggtcgcctgattacagttaacccaatcgtaacagaaaaagatagcccagtcaacatagaagcagaacctccattcggagacagctacatcatcataggagtagagccgggacaactgaaactcaattggtttaagaagggaagttccatcggccaaatgttcgagacaacaatgagaggggcaaagagaatggccattttaggtgacacagcctgggattttggatccctgggaggagtgttcacatccataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggagtcgtgacactatacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagccatccaaaaagctcatgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaatagagcctggaactcgctggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggcaagcttgagatggactttgatctctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgagctgactgatgcgttagccctgggcatgatggtcctcaaaatagtgagaaatatggaaaaataccaattggcagtgactatcatggctatttcgtgtgtcccaaatgcaatgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagttgggatggtgagcattttggccagttctctcctaaagaatgatattcccatgacaggcccattagtggctggagggctccttaccgtgtgttacgtgctcactggacgatcggccgatttggaactggagagagctgccgaggtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaagagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggcccccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagatcctgcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgacatagcagcttgtctcaggaaaaatggaaagaaagtgatacaactcagtaggaagacttttgactctgagtatgttaagactagagccaatgattgggactttgtggtcacgactgacatttcagaaatgggtgccaacttcaaagctgagagggtaatagaccccagacgttgcatgaaaccagttatactaacagatggcgaagagcgggtgatcttggcaggacctatgccagtgacccactctagtgcagcgcaaagaagagggagaataggaagaaatccaaaaaacgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgcccttagtgaactgccggagaccctggagacactgcttctactgacactcctggcaacagtcacaggaggaatcttcctattcttaatgagcggaaaaggtatagggaagatgaccctgggaatgtgttgcataatcacggccagtgtcctcctatggtatgcacagatacaaccacactggatagcagcctcaataatactggagttttttctcatagtcttgctcattccagaaccagaaaaacagagaacaccccaagacaaccaattgacctacgttgtcatagccatcctcacagtggtggctgcaaccatggcaaacgagatgggtttcctggaaaaaaccaagaaagacctcggactgggaagcattacaacccaggaatctgagagcaacatcctagacatagatctacgccctgcatcagcatggacgctgtatgccgtggctacaacatttgttacaccaatgttgagacatagcattgaaaattcctcagtgaatgtctccctaacagccattgctaaccaagctacagtgctaatgggtcttgggaaaggatggccattgtcaaagatggacatcggagttcccctcctcgccatcggatgctactcacaagtcaaccctataactctcacagcagctcttcttctattggtagcacattatgccattatagggccaggactccaagcaaaagcaaccagagaagcacagaaaagagcagcagcaggcatcatgaaaaacccaacagtcgatggaataacagtgattgacctagaaccaataccctatgatccaaaatttgaaaagcagttaggacaagtaatgctcctaatcctatgcgtgactcaagtattaatgatgaggactacatgggctttgtgtgaggctctaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccacgctgtgtcgcgaggttcagcaaaactgagatggttcgtcgagagaaatatggtcacaccggaagggaaggtggtggatctcggttgtggcagagggggctggtcatactattgtgggggactgaagaatgtaagagaagtcaaaggcctaacaaaaggaggaccaggacacgaagaacccatccctatgtcaacatatgggtggaatttagtgcgtctgcaaagcggagttgacgttttcttcaccccgccagaaaaatgtgatacattgttgtgtgacataggggagtcgtcaccaaatcccacgatagaagcaggacgaacactcagagtcctcaacttagtagaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaagacgtgggcttaccatggcagctatgaaacaaaacaaactggatcagcatcatctatggtgaacggagtggtcagactgctgacaaaaccttgggacgtcgtccctatggtgacacagatggcaatgacagacacgactccattcggacaacagcgcgtttttaaagagaaagtagacacgagaacccaagaaccgaaagaaggcactaagaagctgatgaaaatcacggcagagtggctttggaaagaactaggaaagaaaaagacccctagaatgtgtaccagagaagaattcacaagaaaagtgagaagcaatgcagccttgggggctatattcactgatgagaacaaatggaaatcggcacgtgaggctgttgaagatggtaggttttgggagttggttgacagggaaagaaatctccatcttgaaggaaagtgtgaaacatgtgtgtacaacatgatgggaaaaagagagaagaaactaggagagttcggcaaggcaaaaggcagcagagccatatggtacatgtggcttggagcgcgcttcttagagtttgaagccctaggattcctgaatgaagatcactggttctccagagggaactccttgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccatagaagaaatcgctgtacagaactggttagcaagagtggggcgtgaaaggctatcaagaatggcaatcagtggagatgattgtgttgtaaaacccatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6492 - RNA, 9876 nt, synthetic construct
  misc_feature 1..9876: note = derived and/or modified CDS sequence (wt) from DENV-2__GQ868558__SS-prME
  source 1..9876: mol_type = other RNA
acagcaggcgtgattgttatgttgattccaacagcgatagcgttccatttaaccacacgcaatggagaaccacacatgatcgttggtaggcaggagaaagggaaaagccttctgttcaaaacagaggatggtgttaacatgtgtaccctcatggccatagaccttggtgaattgtgtgaagatacaatcacgtacaagtgtcctctcctcaaacaaaatgaaccagaagacatagattgttggtgcaactccacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtggaaggggtttcaggaggaagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatgggggaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggtaatgacacaggaaaacacggcaaggaaatcaaaataacaccacagagttccatcacagaagcagaactgacaggctatggcactgtcacgatggagtgctctccgagaacgggtctcgacttcaatgagatggtgctgctgcagatggaagacaaagcttggctggtgcacaggcaatggttcctagacctgccgttgccatggctacctggagctgacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaagaaatagcagaaacacaacatggaacaatagttatcagagtacaatatgaaggggacggttctccatgtaagatcccttttgagataacagacttggaaaaaagacacgtcttaggtcgcctgattacagttaatccaatcgtaacagaaaaagatagcccagtcaacatagaagcagaacctccattcggagacagctacatcatcataggagtagagccgggacaactgaaactcaattggtttaagaagggaagttccatcggccaaatgttcgagacaacaatgagaggggcaaagagaatggccattttaggtgacacagcctgggattttggatccctgggaggagtgttcacatccataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggagtcgtgacattatacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcgaaaatgcactccacagagtctcacaatcagacctttcttattgatggccctgaaacagcagaatgccccaacacaaatagagcctggaactcgctggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagtaaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggcaagcttgagatggactttgatctctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagatcgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgagctgactgatgcgttagccttgggcatgatggtcctcaaaatagtgagaaatatggaaaaataccaattggcagtgactatcatggctatttcgtgcgtcccaaatgcagtgatactgcgaaacgcatggaaggtgagttgcacgatattggcagcggtgtccgtttctccactgctcttaacatcctcacagcagaaagcggattggataccactggtattgacgataaaaggtctcaatccaacagccatttttctaacaactctttcgagaaccagcaagaaaaggagctggccactaaatgaagctatcatggcagtcgggatggtgagcattttagccagttctctcctaaagaatgatattcccatgacaggcccattagtggctggagggctccttaccgtgtgttacgtgctcactggacgatcggccgatttggaactggagagagctgccgaggtaaaatgggaagatcaggcagaaatatcaggaagcagcccaatcctgtcaataacaatatcagaagatggcagcatgtcgataaagaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacgccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagatccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgacatagcagcttgtctcaggaaaaatggaaagaaagtgatacaactcagtaggaagacttttgactctgagtatgttaagactagagccaatgattgggactttgtggtcacgactgacatttcagaaatgggtgccaacttcaaagctgagagggtaatagaccccagacgttgcatgaaaccagttatactaacagatggcgaagagcgggtgatcttggcaggacctatgccagtgacccactctagtgcagcgcaaagaagagggagaataggaagaaatccaaaaaacgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttaaccctgaacctaatcacagaaatgggcaggcttccaactttcatgactcagaaagcaagaaacgcactggacaacttggctgtgctgcatacggctgaggcaggtggaagggcgtacaatcatgctcttagtgaactgccggagaccctggagacactgcttctactgacactcctggcaacagtcacaggaggaatcttcctattcttaatgagcggaaaaggtatagggaagatgaccctgggaatgtgttgcataatcacggccagtgtcctcctatggtatgcacagatacaaccacactggatagcagcctcaataatactggagttttttctcatagtcttgctcattccagaaccagaaaaacagagaacaccccaagacaaccaattgacctacgttgtcatagccatcctcacagtggtggctgcaaccatggcaaacgagatgggtttcctggaaaaaaccaagaaagacctcggactgggaagcattacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctcctcgccatcggatgctactcacaagtcaaccctataactctcacagcagctcttcttttattggtagcacactatgccattatagggccaggactccaagcaaaagcaaccagagaagcacagaaaagagcagcagcaggcatcatgaaaaacccaacagtcgatggaataacagtgattgacctagaaccaataccctatgatccaaaatttgaaaagcagttaggacaagtaatgctcctaatcctatgcgtgactcaagtattaatgatgaggactacatgggctttgtgtgaggctctaaccctagcgaccggacccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactgaagaatgtaagagaagtcaaaggcctaacaaaaggaggaccaggacacgaagaacccatccctatgtcaacatatgggtggaatttagtgcgtctgcaaagcggagttgacgttttcttcaccccgccagaaaaatgtgatacattgttgtgtgacataggggagtcgtcaccaaatcccacgatagaagcaggacgaacactcagagtcctcaacttagtagaaaattggttgaacaacaacacccaattttgcataaaggtcctcaacccatatatgccctcagtcatagaaaaaatggaaacattacaaaggaagtatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctatgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccattcggacaacagcgcgtttttaaagagaaagtagacacgagaacccaagaaccgaaagaaggcactaagaagctgatgaaaatcacggcagagtggctttggaaagaactaggaaagaaaaagacccctagaatgtgtaccagagaagaattcacaagaaaagtgagaagcaatgcagccttgggggctatattcactgatgagaacaaatggaaatcggcacgtgaggctgttgaagatggtaggttttgggagttggttgacagggaaagaaatctccatcttgaaggaaagtgtgaaacatgtgtgtacaacatgatgggaaaaagagagaagaaactaggagagttcggcaaggcaaaaggcagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccatatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccatagaagaaatcgctgtacagaactggttagcaaaagtggggcgtgaaaggctatcaagaatggcaatcagtggagatgattgtgttgtaaaacccatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6493 - RNA, 9876 nt, synthetic construct
  misc_feature 1..9876: note = derived and/or modified CDS sequence (wt) from DENV-2__KJ189305__SS-prME
  source 1..9876: mol_type = other RNA
acagcaggcgtgattgttatgctgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagacacaatcacctacaagtgtcctctcctcagacaaaatgaaccagaagacatagattgttggtgcaactccacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacattttcaaagggccttgattttcatcttactgacagctgtcgctccttcaatgacaatgcgctgcataggaatatcaaatagagacttcgtagaaggggtttcaggaggaagctgggttgatatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattattcggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggataaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcctgatcacagttaacccaatcgtaacagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggctattttaggtgacacagcctgggattttggatccctgggaggagtgtttacatccataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtactggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccatattctatcagaaaatgaggtaaaattgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaatacaaacagagcttggaactcgctggaagttgaagactatggttttggagtttttaccaccaatatatggctaaaattgaaagaaaaacaggatgtattttgtgactcaaaactcatgtcggcggctatcaaagacaacagagccgttcacgccgatatgggttattggatagaaagtgcactcaatgacacatggaagatggagaaagcctccttcattgaagttaaaagctgccattggccaaagtcacacaccctctggagcaatggagtattagaaagtgagatgataattccaaaaaactttgccgggccagcgtcacaacacaactacagaccaggctactatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaaataccaattggcagtgaccatcatggctatttcgtgtgtcccaaatgcagtgatactgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaggatggagcctacagaattaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacaaaacctggaattttcaaaaccaacaccggaaccataggcgccgtatctctggacttttcccctggaacgtcaggatctccaattgtcgacaaaaaaggaaaggttgtgggtctttacggcaatggtgttgtcacaaggagtggagcgtatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcaaagccgaacacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgacatagcagcttgccttagaaaaaatggaaagaaagtaatacaactcagtaggaagacttttgactctgagtatgttaagactagagccaatgattgggactttgtggtcacaactgacatttcagaaatgggtgccaatttcaaggctgagagggttatagaccccagacgttgcatgaaaccagttatactaacagatggcgaagaacgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagtttttcctcatagttttgctcattccagaaccagaaaaacagagaacaccccaagacaaccaattgacctacgttgtcatagccatcctcacagtggtggctgcaaccatggcaaacgagatgggtttcctggaaaaaaccaagaaagacctcggattgggaagcattacaacccaggaatctgagagcaacatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattataggcccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccatcgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacacgctgggaaaaagtgaatttcagatttacaagaaaagtggaatccaggaagtggatagaaccctagcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctgggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtagatacgagaacccaagaaccgaaggaaggcacgaagaagctgatgaaaatcacggcagagtggctttggaaagaactaggaaagaaaaagacacctaggatgtgtactagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaagcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtaggcaagaaggaagggggagcaatgtacgccgatgatacagcaggatgggacacacgaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaatcagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgatagatttgcaagtgctttaacagctctaaatgacatgggaaaagttaggaaagacatacaacaatgggaaccttcaagaggatggaacgattggacacaagtgcctttctgttcacaccattttcatgagttagtcatgaaagatggtcgcgtgctcgtagtcccatgtagaaaccaagatgaactgattggtagagcccgaatttcccagggagccgggtggtctttgaaggagacggcctgtttggggaagtcttacgcccaaatgtggacccttatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccgtacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6494 - RNA, 9876 nt, synthetic construct
  misc_feature 1..9876: note = derived and/or modified CDS sequence (wt) from DENV-2__FJ898451__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcccctcctcagacaaaatgaaccagaagacatagattgttggtgcaactctacgtccacatgggtaacttatgggacatgtaccaccacaggagaacacagaagagagaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatagttttagaacatggaagttgtgtgacgacgatggcaaaaaacaaaccaacattggattttgaactgataaaaacagaagccaaacaacctgccaccctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggatacacaaggatcaaattggatacagaaagagacattggtcacattcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacctccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgttcacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagttatggtgcaggctgatagtggttgcattgtgagctggaaaaataaagaactgaaatgtggcagcgggatcttcattacagataacgtgcacacatggacagaacaatataagttccaaccagaatccccttcaaaactagcttcagctatccaaaaagcccatgaagaaggcatttgtggaatccgctcagtaacaagattggagaatctgatgtggaaacaaataacaccagaattgaatcatattttatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagttttttccaccaatatatggctaaaattgagagaaaaacaggatgtattttgtgactcaaaactcatgtcagcggccattaaagacaacagagccgtccatgccgatatgggttattggatagaaagtgtactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaagatggatgctggtacgggatggaaatcagacctttgaaagagaaagaggagaacttggtcaactccttggtcacagccggacatgggcagattgacaacttttcactaggagtcttgggaatggcactgttcctggaagaaatgcttaggacccgagtaggaacgaaacatgcaatactgctagttgcactatcttttgtgacattgatcactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccatcctagaactgactgatgcgttagccttgggcatgatggtcctcaaaatagtgagaaatatggaaaaataccaattggcagtgaccatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggcaggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgttacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatatgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggattttcatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaaaactagagccaatgattgggactttgtggtcacaactgacatttcagaaatgggtgccaacttcaaggctgagagggttatagaccctagacgttgcatgaaaccagttatactaacagatggcgaagagcgggtgatcttggcaggacccatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatccttgaccctgaacctaatcacagaaatgggtaggcttccaactttcatgactcagaaggcaagaaacgcactggacaacttggctgtgctgcatacggctgaggtaggtggaagggcgtacaatcatgctctcagtgaactgccggagaccctggagacactgcttctactgacactcctggcaacagtcacaggaggaatcttcttattcttaatgagcggaaaaggtatagggaagatgactctgggaatgtgttgcataatcacagctagcatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgctaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaactcctcagtgaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcttaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtagatagaaccctagcaaaagaaggcatcaaaagaggagaaacggaccaccatgctgtgtcacgaggatcagcaaaactgagatggttcgtcgagagaaatatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacactacaaaggaaatatggaggagccttagtgaggaatccactctcacggaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgttgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaattcacaagaaaagtgagaagcaatgctgccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaacgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagttggcacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacgcaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcctgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgactacggaagacatgctggcagtctggaacagggtgtggatccaagaaaacccatggatggaagacaaaactccagtggaatcatgggaagaagtcccatacctggggaaacgggaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 6495 - RNA, 9876 nt, synthetic construct
  misc_feature 1..9876: note = derived and/or modified CDS sequence (wt) from DENV-2__HM488257__SS-prME
  source 1..9876: mol_type = other RNA
actgcaggcataattattatgatgattccaacagtgatggcgttccatctaaccacacgcaacggagaaccacacatgatcgtcagtagacaagagaaagggaaaagtcttctgtttaaaacagagaacggtgtgaacatgtgtaccctcatggccatggaccttggtgaactgtgtgaagacacaatcacttacaattgtcctcttctcaggcagaatgaaccagaagacatagactgttggtgcaactccacgtctacatgggtaacttatgggacatgcaccgttacaggagaacacagaagggaaaaaagatcagtggcactcgttccacatgtgggaatgggactggagacacgaactgaaacatggatgtcatcagaaggggcctggaaacatgcacagagaattgaaacttgggtcttgagacatccaggcttcaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgatatagtcttggaacatggaagctgtgtgacgacgatggcgaaaaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagatagaggatggggaaatggatgcggattatttggaaagggaggtatcgtgacctgtgcaatgttcacatgcaaaaagaacatggaaggaaaaatcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccattaccatggctgcccggagcagacacacaaggatcaaattggatacagaaggagacattggtcactttcaaaaatccccatgcaaagaaacaggatgttgttgttttaggatcccaagaaggggctatgcacacagcactcacaggggccacggaaatccagatgtcatcaggaaacttactgttcacaggacatcttaaatgcaggctgagaatggacaaactacagctcaaaggaatgtcatattccatgtgtacaggaaagttcaaagttgtgaaggaaatagcagaaacacaacatggaacaatagttatcagagtacaatatgaaggagacggttctccgtgcaagatcccttttgaaataatggatttggaaaaaagacatgtcttaggtcgcttgattacagtcaacccaattgtcacagaaaaagacagcccagtcaacatagaagcagaacctccattcggagacagctacatcattgtaggagtagaaccgggacaactgaagctcagctggtttaagaaaggaagttctattggccaaatgtttgagacaacaatgagaggagcgaagagaatggccattttaggtgatacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggagtcgtgacattgtatttgggagttatggtgcaggccgatagtggttgcgttgtgagttggaaaaacaaagaactgaaatgtggcagtgggatttttatcacagacaacgtgcacacatggacagaacaatacaaattccaaccagaatccccttcaaagctggcttcagctatccagaaggctcatgaagagggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcactagaggttgaagactatggctttggagtattcaccaccaacatatggctgaaattgaaagaaaggcaggatgtattttgtgactcaaaactcatgtcagcagccataaaagacaacagagccgtccacgccgatatgggttattggatagaaagcgcactcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaaccacagtggtggtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttatgcagctggactactcttaagaaagttgacctccaaggaattaatgatgaccaccataggaatcgtactcctctctcagagcaccataccagagactatacttgaactgactgacgcgttggctttggggatgatggttctcaaaatagtaagaaacatggaaaagtatcaactagcagtgactatcatggctatcttgtgcgtcccaaatgcagtgatattacaaaacgcatggaaagtgagctgcacaacactggcaatggtgtccgtttccccactgcttttaacatcctcacagcagaaagcggattggataccactggcgttgacgatcaaaggcctcaatccaacagccattttcttaacaaccctctcaaggactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggagagagctgctgacgtaagatgggaagaacaggcagagatatcaggaagcagtccaattctgtcgataacaatatcggaagatggtagcatgtcgataaaaaatgaagaagaagaacaaacactgaccatactcattagaacaggactgctggtgatatcaggactttttcccgtgtcaataccaatcacggcagctgcatggtacctgtgggaagtgaaaaaacaacgagctggagtattgtgggatgtcccttcacctccacctgtgggaaaggccgaactggaagatggagcctatagaatcaagcagaaagggattctaggatactcgcagatcggagccggagtttacaaagaaggaacattccacacaatgtggcatgtcacacgtggtgctgttctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggcgccgtatctctggacttttctcctggaacgtcaggatccccaattgtcgacaaaaaaggaaaagttgtgggcctttatggcaacggtgtcgtcacaaggagtggaacatatgtgagtgccatagcccagactgaaaaaagcatcgaagacaatccagagattgaagatgacatctttcgaaagaaaagattgaccatcatggacctccacccaggagcaggaaaaacaaagagataccttccagcgatagtcagagaagccataaaacgaggcttgagaacactaatcctggcccccactagagttgtggcggctgaaatggaagaagctctcagaggacttccaataagataccaaaccccagccatcagagctgagcacactggacgggagattgtggatctaatgtgtcacgccacatttaccatgaggctgctatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccatttcctcagagcaacgcaccaatcatggatgaagaaagggaaatccctgagcgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggctgagagggttatagaccccagacgctgcatgaaaccagtcatactaacagacggtgaagagcgtgtgatcctggcaggacccatgccagtgacccactctagtgcagcacaaagaagagggagagtaggaagaaatccgaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggacgccattgatggtgaataccgcttgagaggagaagcgaggaaaacatttgtggacctaatgagaagaggagacctaccagtctggctagcctacagagtggcagctgaaggtatcaactacgcagacagaagatggtgctttgatggagtcaagaacaaccaaatcttggaagaaaatgtggaagtggaaatttggacgaaagaaggagaaaggaagaaattaaaacccagatggttagatgctaggatctactctgacccactggcgctcaaagaattcaaggaattcgcagctggaagaaaatccctgaccttgaatctaatcaccgagatgggtaggctcccaaccttcatgacccagaaagcaaggaatgcattggacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaagcattacaacccagcaacctgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagttccccttctcgctatcggatgctattcacaagtcaaccccataactctcacagcagcccttctcttattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcgaccgggcccatctctacactgtgggaaggaaacccagggagattttggaatacaactattgcagtgtcaatggctaacatttttagagggagttacctggccggagccggacttctcttttctatcatgaagaacacggctaacacaagaaggggaactggcaacacaggagagacgcttggagagaaatggaaacaccggttgaatgcattggggaagagtgaattccagatctataagaaaagtggaatccaggaagtggatagaaccttagcaaaagaaggcatcaaaagaggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgtcttttttactccgccagaaaagtgtgacacattgctgtgtgacataggggagtcgtcaccaaaccccacggttgaggcaggacgaacactcagagttctaaacttagtggaaaactggctgaacaacaacacccaattttgcataaaggttctcaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgatctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagggaagaattcacaagaaaggtgagaagcaatgcagccttaggtgccatattcactgacgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggcttggagcacgcttcttagagtttgaagccctaggattcttgaatgaagatcactggttttccagaaagaactccctgagtggagtggaaggagaagggctgcacaaactaggttacattttaagagacgtgagtaagaaagaaggaggagcaatgtacgccgatgacaccgcaggatgggacacaagaatcacactagaggacttgaaaaatgaagaaatggtgacaaaccacatggaaggagaacacaagaaacttgctgaagccattttcagattaacgtaccaaaacaaggtggtgcgtgtgcaaagaccgacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcacctgacagccacagaagaaattgcagtgaaaacctggttagtaagagtggggcgtgagaggttatcaagaatggccatcagtggagatgactgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtactcgtagttccatgtagaaaccaagatgaactgattggtagggctcgaatttcccagggagccgggtggtccttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacgacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagagccacctgggcaaagaacatccaaacagcaataaatcaagttagatccctaataggcaatgaggaatacacagactacatgccatccatgaaaagattcagaagagaagaggaagaggcaggggtcttgtggtag

SEQ ID NO: 6496 - RNA, 9876 nt, synthetic construct
  misc_feature 1..9876: note = derived and/or modified CDS sequence (wt) from DENV-2__HQ999999__SS-prME
  source 1..9876: mol_type = other RNA
acagcaggcgtgattgttatgttgattccaacggcgatggcgttccatttgaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatattcagagaattgaaacctggatcttgagacatccaggttttaccataatggcagcaatcttggcatacactataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaaccagccactctaaggaagtactgtatagaagcaaagctgaccaacacaacaacagaatcacgttgtccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaatatggaaggaaaagtcgtgcagccagaaaacttggaatacaccatcgtgataacaccccactcaggagaagagcacgctgtaggtaatgacacaggaaagcatggcaaagaaatcaagataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaactggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgatcacagttaacccaatcgtaacagaaaaagatagcccaatcaacatagaagcagaacctccattcggagacagctacatcatcataggagtagagccgggacaattgaaactcaattggtttaagaagggaagttccatcggccaaatgtttgagacaacaatgagaggagcaaagagaatggccattctaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccatattctatcagaaaatgaggtaaagttgaccattatgacaggagacattaaaggaatcatgcaggcaggaaaacgatctttgcggccccagcccactgagctgaagtattcatggaaaacatgggggaaggcgaaaatgctctccacagagtctcacaatcagacctttcttattgatggccctgaaacagcagaatgccccaacacaaacagagcttggaactcactggaagttgaagactatggttttggagttttcaccaccaatatatggctgaaattgaaagaaaaacaggatgtattttgtgactcaaaactcatgtcagcggccattaaagacaacagagccgttcatgccgatatgggttattggatagaaagcgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtaactgaggattgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagaaaaagaggagaatttggtcaactccttggtcacagccggacatgggcagattgacaacttttcattaggagtcctgggaatggcactgttcctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaactgatgatggccaccataggaatcgcactcctttcccaaagcaccataccagagaccattcttgaactgactgatgcattagccttgggcatgatggtcctcaaagtggtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcacgaaaaggagctggccgctaaatgaagctatcatggcagtcgggatggtgagcattttagccagttctctcctaaagaatgacattcctatgacaggtccattagtggctggagggctccttaccgtatgttatgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgagctggaggatggagcctacagaatcaagcaaagagggattcttggatattctcagataggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccccggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagctgggattttcatgacagccactcctccgggaagtagagacccatttcctcagagcaacgcaccgatcatggatgaggaaagagaaatccctgagcgttcgtggaattcaggacacgaatgggtcacggattttaaggggaagactgtttggtttgttccaagtataaaagcaggaaatgatatagcagcctgtcttaggaaaaatggaaagaaagtgatacaactcagtaggaagacttttgactctgagtatgttaagactagagccaatgattgggactttgtggtcacaactgacatctcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaatacacccgaaggaatcattcctagtatgttcgaaccagagcgtgaaaaagtggatgccattgatggtgaataccgtttgagaggggaagcaaggaaaacctttgtggacctaatgagaagaggggacttaccagtctggttggcctacaaagtggcagctgaaggcatcaactacgcagacagaaggtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcacacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacagctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttctcacaccaatgttgagacatagcattgaaaattcctcagtgaatgtctccctaacagccattgctaaccaagctacagtgctaatgggtcttgggaaaggatggccattgtcaaagatggacattggagctcccctccttgccattggatgctattcacaagtcaaccctataactctcacagcagctcttcttctattggtagcacattatgccattatagggccagggcttcaagcaaaagcaaccagagaagctcagaaaagagcagcagcaggcatcatgaaaaacccaacagtcgatggaataacagtgattgacctagacccaataccctatgatccaaaatttgaaaagcagctaggacaagtgatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgccgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacactcagagtcctcaacttagtggaaaattggttaaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgatctaggaagtggaacccgtaacatcggaattgaaagtgaggtaccaaatctagacataataggaaagagaatagagaaaataaaacaagagcatgaaacatcatggcactatgatcaagaccacccatacaaaacgtgggcttaccatggcagttatgaaacaaaacaaactggatcagcatcatctatggtgaacggagtggtcagattgctgacaaaaccttgggacgtcgtccctatggtgacacagatggcgatgacagacacgactccatttggacaacagcgcgttttcaaagagaaagtagacacgagaacccaagaaccgaaggaaggcacaaagaaactgatgaaaattacagcagagtggctttggaaagaactaggaaagaaaaaaacacccaggatgtgtaccagagaagaattcacaagaaaagtgagaagcaacgcagccttgggggccatattcactgatgagaacaaatggaaatcggcacgtgaggctgttgaagatggcaggttttgggagctggttgacagggaaagaaatctccatcttgaaggaaagtgtgaaacatgtgtgtataacatgatgggaaaaagagagaagaaactgggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagaagtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaataaggtggtgcgtgtgcaaagaccaacaccaagaggcacagtaatggacatcatatcgagaagagaccaaagaggcagtgggcaagtcggcacctatggccttaacactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccatagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacttgggcaaagaatatccaaacagcaataaatcaagtcagatcccttataggcaatgaggaatacacagactacatgccatccatgaagagattcagaagggaagaggaagaggcaggtgtcctgtggtag

SEQ ID NO: 6497 - RNA, 9876 nt, synthetic construct
  misc_feature 1..9876: note = derived and/or modified CDS sequence (wt) from DENV-2__FJ898449__SS-prME
  source 1..9876: mol_type = other RNA
actgcaggcatgatcatcatgctgattccaacagtgatggcgtttcatctgaccacacgcaacggagaaccacacatgatcgtcagtaggcaagaaaaagggaaaagccttctgtttaagacaaaggatggcacgaacatgtgtactctcatggccatggaccttggtgagttgtgtgaagacacaatcacgtataaatgtccttttctcaagcagaacgaaccagaagacatagattgttggtgcaactccacgtccacatgggtaacttacgggacatgtaccactacaggagagcacagaagagaaaaaagatcagtggcgcttgttccacacgtgggaatgggattggagacacgaactgaaacatggatgtcatcagaaggggcctggaaacatgcccagagaattgaaacttggattctgagacatccaggctttaccataatggccgcaatcctggcatacaccataggaacgacgcatttccaaagagtcctgatattcatcctactgacagccatcgctccttcaatgacaatgcgctgcataggaatatcaaatagggactttgtggaaggagtgtcaggaggaagttgggttgacatagttttagaacatggaagttgtgtgacgacgatggcaaaaaataaaccaacactggactttgaactgataaaaacagaagccaaacaacccgccaccttaaggaagtactgtatagaggctaaactgaccaacacgacaacagactcgcgctgcccaacacaaggggaacccaccctgaatgaagagcaggacaaaaggtttgtttgcaaacattccatggtagacagaggatggggaaatggatgtggattgtttggaaaaggaggcatcgtgacctgtgctatgttcacatgcaaaaagaacatggaaggaaaaattgtgcagccagaaaacctggaatacactgtcgtgataacacctcattcaggggaagaacatgcagtcggaaatgacacaggaaaacatggtaaagaagtcaagataacaccacagagctccatcacagaggcggaactgacaggctatggcactgttacgatggagtgctctccaagaacgggtctcgacttcaatgagatggtgttgctgcaaatggaagacaaagcttggctggtgcacagacaatggttcctagacctaccgttgccatggctgcccggagcagacacacaaggatcaaattggatacagaaagagacattggtcaccttcaaaaatccccatgcgaaaaaacaggatgttgttgtcttaggatcccaagaaggggccatgcatacagcactcacaggggctacggaaatccagatgtcatcaggaaacctgctgttcacaggacatctcaaatgcaggctgaggatggacaaattacaacttaaagggatgtcatactccatgtgcacaggaaagtttaaaattgtgaaggaaatagcagaaacacaacatggaacaatagtcattagagtacaatatgaaggagacggctctccatgcaagatcccctttgagataatggatctggaaaaaagacatgttttgggccgtctgatcacagtcaacccaattgtaacagaaaaggacagtccagtcaacatagaagcagaacctccattcggagacagctacatcatcataggagtggaaccaggacaattgaagctggactggttcaagaaaggaagttccatcggccaaatgtttgagacaacaatgaggggagcgaaaagaatggccatcttgggcgacacagcctgggattttggatctctgggaggagtgttcacatcaataggaaaagctctccaccaggttttcggagcaatctacggggctgctttcagtggggtctcatggactatgaagatccttataggagttatcatcacatggataggaatgaactcacgtagcacatcactgtctgtgtcactggtattagtgggaatcgtgacactgtacttgggagttatggtgcaagccgatagtggttgcgttgtgagctggaagaacaaagaactaaaatgtggcagtggaatattcgtcacagataacgtgcatacatggacagaacaatacaagttccaaccagaatccccttcaaaactggcttcagccatccagaaagctcacgaagaaggcatttgtggaatccgctcagtaacaagactagaaaatcttatgtggaaacagataacatcagaattgaatcatattctatcagaaaatgaagtgaaactgaccatcatgacaggagacatcaaaggaattatgcaggtgggaaaacgatccctgcggcctcaacccactgagttgaggtattcatggaaaacatggggcaaagcgaaaatgctctccacagaactccacaatcagaccttcctcattgatggtcccgaaacagcagaatgccccaacacaaacagagcttggaattcactagaagttgaggactatggctttggagtattcactaccaatatatggctaagattgagagaaaagcaggatgtattttgtgactcaaaacttatgtcagcggccataaaggacaacagagccgtccatgctgatatgggttattggatagaaagcgcactcaatgatacatggaagatagagaaagcttctttcattgaagtcaaaagttgccactggccaaagtcacacactctatggagtaatggagtgctggaaagcgagatgataattccaaagaatttcgctggaccagtgtcacaacacaataacagaccaggctatcacacacaaacagcaggaccttggcatctaggcaagcttgagatggactttgatttctgcgaagggaccacagtggtggtaaccgaggaatgtggaaacagagggccttctttaagaacaaccactgcctcaggaaaactcataacggaatggtgttgtcgatcttgcacactaccaccactaagatacagaggtgaggatggatgctggtacgggatggaaatcagaccattgaaagagaaagaagaaaatctggtcagttctctggtcacagccggacatgggcagattgacaatttctcattaggaattttgggaatggcactgttccttgaagaaatgctcaggactcgagtaggaacgaaacatgcaatactactagtcgcagtttctttcgtaacgttaatcacagggaacatgtcttttagagacctgggaagagtgatggttatggtgggtgccaccatgacagatgacataggtatgggtgtgacttatcttgctctactagcggccttcaaagtcagaccaacctttgcagctggactgctcttgagaaaactgacctccaaggaattaatgatgaccaccataggaatcgttcttctctctcagagtagcataccagagaccattcttgagctgaccgatgcgttagctttaggcatgatggtcctcaagatggtgagaaacatggaaaaatatcagctggcagtgactatcatggctattctgtgtgtcccaaatgctgtgatattacagaacgcatggaaagtgagttgcacaatactggcagtggtgtctgtttcccccctgctcttgacatcctcacaacagaaagcggactggataccattagcgttgacgatcaaaggcctcaacccaacagccatttttctaacaaccctctcaagaactagcaagaaaaggagctggcctttaaacgaggccatcatggcggttgggatggtgagtatcttggccagctctctcttgaagaacgacatccccatgacaggaccattagtggctggagggcttcttactgtgtgctacgtattaactgggcggtcagccgatctggaactagagagagctaccgatgtcaaatgggatgaccaggcagagatatcaggtagcagtccaattctgtcaataacaatatcagaagatggcagcatgtcgataaagaatgaagaggaagagcaaacactgactatactcattagaacaggattgcttgtgatctcaggactctttccggtatcaataccaattacagcagcagcatggtacctgtgggaagtaaagaaacaacgggctggagtgttgtgggatgtcccctcaccaccacccgtgggaaaggctgaattggaagatggagcctacagaatcaagcaaaaaggaatcctaggatattcccagatcggagctggagtttacaaagaaggaacatttcacaccatgtggcacgtcacacgtggcgctgtcctaatgcataaggggaagaggattgaaccgtcatgggcggacgtcaagaaagacttaatatcatatggaggaggttggaaactagaaggagaatggaaagaaggagaagaagtccaggtcttggcattggagcctgggaaaaatccaagagccgtccaaacaaaacctggcctttttagaaccaatactggaaccataggtgccgtatccctggacttttcccctgggacgtcaggatctccaatcgttgacaaaaaaggaaaagttgtaggcctctatggcaatggtgtcgttacaaggagtggagcatatgtgagtgccatagctcagactgaaaaaagcattgaagacaatccagagattgaagatgacatctttcgaaagagaagattgactatcatggatctccacccaggagcaggaaagacaaagaaatacctcccggccatagtcagagaggccataaaaagaggcttgagaacactaatcctagcccccactagagtcgtggcagctgaaatggaggaagcccttagaggacttccaataagataccaaactccagccatcagggctgagcacaccgggcgggaaatcgtggacttaatgtgtcatgccacatttaccatgaggctgctatcaccaatcagggtgccaaattacaacctgatcatcatggatgaagcccattttacagatccagcaagcatagcagctaggggatacatctcaactcgagtggagatgggtgaggcagctggaatttttatgacagccactcctccgggtagcagagatccatttcctcagagtaatgcaccaattatggacgaagaaagagaaattccggaacgttcatggaactccgggcacgagtgggtcacggattttaaaggaaagactgtctggtttgttccaagcataaaaaccggaaatgacatagcagcctgcctgagaaagaatggaaagagggtgatacaactcagtaggaagacctttgattctgaatacgtcaagactagaaccaatgactgggatttcgtggttacaactgacatttcggaaatgggtgccaactttaaagctgagagggttatagaccccagacgctgcatgaaaccagttatactaacagacggcgaagagcgggtgattctggcaggacccatgccagtgacccactccagtgcagcacaaagaagagggagaataggaaggaatccaaggaatgaaaatgatcaatacatatatatgggagaacccctggaaaatgatgaagactgtgcgcattggaaggaagctaagatgctcctagataacatcaacacacctgaaggaatcattcccagcatgttcgagccagagcgtgaaaaggtggatgccattgacggtgaatatcgcttgagaggagaagcacggaaaacttttgtggacctaatgagaagaggagacctaccagtctggttggcttataaagtggcatctgaaggtatcaactacgcagacagaagatggtgttttgacggaaccagaaacaatcaaattttggaagaaaatgtggaagtggaaatctggacaaaggaaggggaaaggaaaaaattgaaacctagatggttagatgctaggatctactccgacccactggcgctaaaagaattcaaggaattcgcagccggaagaaagtccctaaccctgaacctaatcacagagatgggcagactcccaacttttatgactcagaaggccagagatgcactagacaacttggcggtgctgcacacggctgaagcgggtggaaaggcatacaatcatgctctcagtgaactaccggagaccctggagacattgcttttgctgacactgttggccacagtcacgggaggaatctttctattcctgatgagcggaaggggtatagggaagatgaccctgggaatgtgctgcataatcacggccagcatcctcttatggtatgcacaaatacaaccacattggatagcagcttcaataatattggagttctttctcatagtcttgctcattccagaaccagaaaagcagaggacaccccaggataatcaattgacttatgtcatcatagccatccttacagtggtggccgcaaccatggcaaacgaaatgggttttctagaaaaaacaaagaaagacctcggactgggacacattgcaacccagcaacctgagagcaacattctggacatagacctacgtcctgcatcagcatggacgttgtatgccgtggctacaacatttatcacaccaatgttgagacatagcattgaaaattcctcagtaaatgtatccctaacagccatagctaaccaagccacagtgctaatgggtctcgggaaaggatggccattgtcaaagatggacattggagttcccctccttgccattgggtgttactcacaagtcaaccctataaccctcacagcggctcttcttttattggtagcacattatgccatcataggaccgggacttcaagccaaagcaaccagagaagctcagaaaagagcagcggcgggcatcatgaaaaacccaactgtggatggaataacagtgatagatctagatccaataccctatgatccaaagtttgaaaagcagttgggacaagtaatgctcctagtcctttgtgtgacccaagtgctgatgatgaggactacgtgggctttgtgtgaagccttaactctagcaaccggacccgtgtccacattgtgggaaggaaatccagggagattctggaacacaaccattgcagtgtcaatggcaaacatctttagagggagttaccttgctggagctggacttctcttttctatcatgaagaacacaactagcacgagaagaggaactggcaacataggagaaacgctaggagagaagtggaaaagcagactgaacgcattggggaaaagtgaattccagatctacaaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggacctcggttgcggcagagggggctggtcatactattgtggaggattgaagaatgtaagagaagttaaaggcttaacaaaaggaggaccaggacacgaagaacctatccctatgtcaacatatgggtggaatctagtacgcttacagagcggagttgacgttttttttgttccaccagagaggtgtgacacattgttgtgtgacataggggaatcatcaccaaatcccacagtagaagcgggacgaacacttagagtcctcaacctagtggaaaattggctgaacaataacacccaattttgcgtaaaagttcttaacccgtacatgccctcagtcattgaaagaatggaaaccttacaacggaaatacggaggagccttggtgagaaatccactctcacggaattccacacatgaaatgtactgggtgtccaatgcctccgggaacatagtgtcatcagtgaacatgatttcaagaatgctgattaacagattcaccatgagacacaagaaggccacctatgagccagatgtcgacctcggaagcggaacccgcaacattggaattgaaagtgagacaccgaacctagacataattggaaaaagaatagaaaaaataaaacaagagcatgaagcgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggacacgagaacccaagaaccaaaagaaggcacaaaaaaactaatgaaaatcacggcagagtggctctggaaagaactaggaaaggaaaagacacctagaatgtgcaccagagaagaatttacaaaaaaggtgagaagcaatgcagccttgggggccatatttaccgatgagaacaagtggaaatcggcgcgtgaggctgttgaagataataggttttgggagctggttgacaaggaaagaaacctccatcttgaaggaaaatgtgaaacatgtgtatacaacatgatgggaaaaagagagaaaaaactaggagagtttggtaaagcaaaaggcagcagagccatatggtacatgtggctcggagcacgcttcttagagtttgaagccttaggatttttgaatgaagaccattggttctccagagagaactccctgagtggagtggaaggagaagggctgcataaactaggttacatcctaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtaccaaaacaaggtggtgcgtgtgcaaagaccaacaccaagaggcacggtaatggacatcatatcgagaagagaccaaaggggtagtggacaagttggcacctatggcctcaacactttcaccaacatggaagcacaactaattaggcaaatggagggggaaggaatcttcaaaagcatccagcacttgacagcctcagaagaaatcgctgtgcaagattggctagtaagagtagggcgtgaaaggttgtcaagaatggccatcagtggagatgattgtgttgtgaaacctttagatgatagatttgcaagagctttaacagctctaaatgacatgggaaaggttaggaaggacatacagcaatgggagccctcaagaggatggaacgactggacacaggtgcccttctgttcacaccattttcacgagttaattatgaaagatggtcgcacactcgtggttccatgcagaaaccaagatgaattgatcggcagagcccgaatttcccagggagctgggtggtctttacgggagacggcctgtttggggaagtcttacgcccaaatgtggagtttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacagagtgtggatcctagaaaatccatggatggaagacaaaaccccagtggaatcatgggaggaaatcccatacctgggaaaaagagaagaccaatggtgcggctcgctgatcgggctgacaagcagagccacctgggcgaagaatatccagacagcaataaaccaagtcagatccctcattggcaatgaggaatacacagattacatgccatccatgaaaagattcagaagagaagaggaagaggcaggggttttgtggtag

SEQ ID NO: 6498 - RNA, 9876 nt, synthetic construct
  misc_feature 1..9876: note = derived and/or modified CDS sequence (wt) from DENV-2__FJ906966__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctgtttaaaacagaggatggtgtgaacatgtgtaccctcatggccatggaccttggtgaattgtgtgaagatacaatcacgtacaagtgtccttttctcaagcagaatgaaccagaagacatagattgttggtgcaactctacgtccacatgggtaacttatgggacgtgtaccaccacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccataatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacagaagccaaacaacctgccactctaaggaagtactgtatagaggcaaagctgaccaacacaacaacagattctcgctgcccaacacaaggagaacccagcctaaatgaagagcaggacaaaaggttcgtctgcaaacactccatggtggacagaggatggggaaatggatgtggactatttggaaaaggaggcattgtgacctgtgctatgttcacatgcaaaaagaacatggaaggaaaagtcgtgcaaccagaaaacttggaatacaccattgtgataacacctcactcaggggaagagcatgcagtcggaaatgacacaggaaaacatggcaaggaaatcaaaataacaccacagagttccatcacagaagcagagttgacaggctatggcactgtcacgatggagtgctctccgagaacgggcctcgacttcaatgagatggtgttgctgcaaatggaaaataaagcttggctggtgcacaggcaatggttcctagacctgccgttgccatggctgcccggagcggacacacaaggattaaattggatacagaaagagacattggtcactttcaaaaatccccatgcgaagaaacaggatgttgttgttttgggatcccaagaaggggccatgcacacagcactcacaggggccacagaaatccagatgtcatcaggaaacttactgttcacaggacatctcaagtgcaggctgaggatggacaaactacagctcaaaggaatgtcatactctatgtgcacaggaaagtttaaagttgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacagaaaaagatagcccagtcaacatagaagcagaacctccattcggagacagctacatcatcataggagtagagccgggacaattgaagctcaactggtttaagaaaggaagttctatcggccaaatgattgagacaacaatgaggggagcgaagagaatggccattttaggtgacacagcttgggattttggatccctgggaggagtgtttacatctataggaaaggctctccaccaagttttcggagcaatctatggggctgccttcagtggggtctcatggattatgaaaatcctcataggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaagtgtggcagtgggattttcatcacagacaacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcagccccagcccactgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaaaagcaggatgtattctgcgactcaaaactcatgtcagcggccataaaagacaacagagccgtccatgccgatatgggttattggatagaaagtgcactcaatgacacatggaagatagagaaagcctctttcatcgaagttaaaagctgccactggccaaagtcacacaccctctggagtaatggagtgttagaaagtgagatgataattccaaagaatttcgctggaccagtgtcacaacacaactacagaccaggctaccatacacaaacagcaggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccataggaatcgtactcctctcccagagcaccataccagagaccattcttgaactgactgatgcgttagccttgggcatgatggtccttaaaatggtgagaaaaatggaaaagtatcaattggcagtgactatcatggctatcttgtgcgtcccaaatgcagtgatattacaaaacgcatggaaagtgagttgcacaatattggcagtggtgtccgtttccccactgttcttaacatcctcacagcagaaagcggattggataccattagcattgacgatcaagggtctcaatccaacagctatttttctaacaaccctttcaagaaccaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctgtatcaataccaatcacggcagcagcatggtacctgtgggaagtgaagaaacaacgggctggagtattgtgggatgtcccttcacccccacccgtgggaaaggctgaactggaagatggagcctatagaatcaagcaaaaagggattcttggatattcccagatcggagccggagtttacaaagaaggaacattccatacaatgtggcatgtcacacgcggcgctgttctaatgcataaaggaaagaggattgaaccatcatgggcggacgttaagaaagacctaatatcatatggaggaggctggaagctagaaggagaatggaaggaaggagaagaagtccaggtcttggcattggagcctggaaaaaatccaagagccgtccaaacaaaacctggtcttttcaaaaccaacgccggaaccataggtgccgtatctctggacttttctcctggaacctcaggatctccaatcatcgacaaaaaaggaaaagttgtgggtctttatggtaatggtgttgttacaaggagtggagcatatgtgagtgctatagcccagactgaaaaaagtattgaagacaatccagagatcgaagatgacatttttcgaaagagaaaattgaccatcatggacctccacccaggagcgggaaagacgaagagataccttccggccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataaaagcaggaaatgatatagcagcttgcctgagaaaaaatggaaagaaagtgatacaactcagtaggaagacctttgattctgagtatgtcaagactagaaccaatgattgggacttcgtggtcacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagctgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaggatctactctgacccactggcgctaaaggaattcaaggagtttgcagctggaagaaagtccctgaccctgaacctaatcacagaaatgggtaggcttccaactttcatgactcagaaggcaagagacgcactggacaacttagcagtgctgcacacggctgaagcaggtggaagggcgtacaatcatgctctcagtgaactgccggagaccctggagacattgcttttactgacacttctggctacagtcacaggaggaatctttttattcttgatgagcggaaggggtatagggaagatgaccctgggaatgtgctgcataatcacggctagtattctcctatggtacgcacaaatacagccacattggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcattacaacccagcaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaagcaaccagagaagctcagaaaagagcagcagcgggcatcatgaaaaacccaactgtcgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacatttttagagggagttacttggccggagctggacttctcttttccatcatgaagaacacaaccaacacgagaaggggaactggcaacataggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctaacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgagacacaagaaagccacttacgagccagatgtagacctcggaagcggaacccgcaacatcggaattgaaagtgagataccaaacctagacataatcgggaaaagaatagaaaaaataaaacaagagcatgaaacatcatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtgacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagacaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtataacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccttgagtggagtggaaggagaagggctgcacaagctaggttacattttaagagacgtgagcaagaaagagggaggagcaatgtatgccgatgacaccgcaggatgggacacaagaatcacactagaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagtcttcaaaagcattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtacttgtagttccatgcagaaaccaagatgaactgattggtagagcccgaatttcccaaggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6499 - RNA, 9876 nt, synthetic construct
  misc_feature 1..9876: note = derived and/or modified CDS sequence (wt) from DENV-2__FJ906968__SS-prME
  source 1..9876: mol_type = other RNA
actgcaggcatgatcattatgctgattccaacggtgatggcgttccatttaaccacacgtaacggagaaccacacatgatcgtcagtagacaagagaaagggaaaagtcttctgtttaaaacagaggatggtgtgaacatgtgtaccctcatggccatggaccttggtgaattgtgtgaagatacaatcacgtacaagtgtccttttctcaagcagaatgaaccagaagacatagattgttggtgcaactctacgtccacatgggtaacttatgggacgtgtaccaccacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccataatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacagaagccaaacaacctgccactctaaggaagtactgtatagaggcaaagctgaccaacacaacaacagattctcgctgcccaacacaaggagaacccagcctaaatgaagagcaggacaaaaggttcgtctgcaaacactccatggtggacagaggatggggaaatggatgtggactatttggaaaaggaggcattgtgacctgtgctatgttcacatgcaaaaagaacatgaaaggaaaagtcgtgcaaccagaaaacttggaatacaccattgtgataacacctcactcaggggaagagcatgcagtaggaaatgacacaggaaaacatggcaaggaaatcaaaataacaccacagagttccatcacagaagcagagttgacaggctatggcactgtcacgatggagtgctctccgagaacgggcctcgacttcaatgagatggtgttgctgcaaatggaaaataaagcttggctggtgcacaggcaatggttcctagacctgccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggaaacttactgttcacaggacatctcaagtgcaggctgaggatggacaaactacagctcaaaggaatgtcatactctatgtgcacaggaaagtttaaagttgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacagaaaaagatagcccagtcaacatagaagcagaacctccattcggagacagctacatcatcataggagtagagccgggacaattgaagctcaactggtttaagaaaggaagttctatcggccaaatgattgagacaacaatgaggggagcgaagagaatggccattttaggtgacacagcttgggattttggatccctgggaggagtgtttacatctataggaaaggctctccaccaagttttcggagcaatctatggggctgccttcagtggggtctcatggattatgaaaatcctcataggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaagtgtggcagtgggattttcatcacagacaacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcagccccagcccactgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaaaagcaggatgtattctgcgactcaaaactcatgtcagcggccataaaagacaacagagccgtccatgccgatatgggttattggatagaaagtgcactcaatgacacatggaagatagagaaagcctctttcatcgaagttaaaagctgccactggccaaagtcacacaccctctggagtaatgaagtgttagaaagtgagatgataattccaaagaatttcgctggaccagtgtcacaacacaactacagaccaggctaccatacacaaacagcaggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccataggaatcgtactcctctcccagagcaccataccagagaccattcttgaactgactgatgcgttagccttgggcatgatggtccttaaaatggtgagaaaaatggaaaagtatcaattggcagtgactatcatggctatcttgtgcgtcccaaatgcagtgatattacaaaacgcatggaaagtgagttgcacaatattggcagtggtgtccgtttccccactgttcttaacatcctcacagcagaaagcggattggataccattagcattgacgatcaagggtctcaatccaacagctatttttctaacaaccctttcaagaaccaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaatactgaccatactcattagaacaggattgctggtgatctcaggactttttcctgtatcaataccaatcacggcagcagcatggtgcctgtgggaagtgaagaaacaacgggctggagtattgtgggatgtcccttcacccccacccgtgggaaaggctgaactggaagatggagcctatagaatcaagcaaaaagggattcttggatattcccagatcggagccggagtttacaaagaaggaacattccatacaatgtggcatgtcacacgcggcgctgttctaatgcataaaggaaagaggattgaaccatcatgggcggacgttaagaaagacctaatatcatatggaggaggctggaagctagaaggagaatggaaggaaggagaagaagtccaggtcttggcattggagcctggaaaaaatccaagagccgtccaaacaaaacctggtcttttcaaaaccaacgccggaaccataggtgccgtatctctggacttttctcctggaacctcaggatctccaatcatcgacaaaaaaggaaaagttgtgggtctttatggtaatggtgttgttacaaggagtggagcatatgtgagtgctatagcccagactgaaaaaagtattgaagacaatccagagatcgaagatgacatttttcgaaagagaaaattgaccatcatggacctccacccaggagcgggaaagacgaagagataccttccggccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataaaagcaggaaatgatatagcagcttgcctgagaaaaaatggaaagaaagtgatacaactcagtaggaagacctttgattctgagtatgtcaagactagaaccaatgattgggacttcgtggtcacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagctgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaggatctactctgacccactggcgctaaaggaattcaaggagtttgcagctggaagaaagtccctgaccctgaacctaatcacagaaatgggtaggcttccaactttcatgactcagaaggcaagagacgcactggacaacttagcagtgctgcacacggctgaagcaggtggaagggcgtacaatcatgctctcagtgaactgccggagaccctggagacattgcttttactgacacttctggctacagtcacaggaggaatctttttattcttgatgagcggaaggggtatagggaagatgaccctgggaatgtgctgcataatcacggctagtattctcctatggtacgcacaaatacagccacactggatagcagcttcaataatactggagttttttcttatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcattacaacccagcaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaagcaaccagagaagctcagaaaagagcagcagcgggcatcatgaaaaacccaactgtcgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacatttttagagggagttacttggccggagctggacttctcttttccatcatgaagaacacaaccaacacgagaaggggaactggcaacataggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctaacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgagacacaagaaagccacttacgagccagatgtagacctcggaagcggaacccgcaacatcggaattgaaagtgagataccaaacctagacataatcgggaaaagaatagaaaaaataaaacaagagcatgaaacatcatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtgacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtataacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccttgagtggagtggaaggagaagggctgcacaagctaggttacattttaagagacgtgagcaagaaagaaggaggagcaatgtatgccgatgacaccgcaggatgggacacaagaatcacactagaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagtcttcaaaagcattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtacttgtagttccatgcagaaaccaagatgaactgattggtagagcccgaatttcccaaggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6500 - RNA, 9876 nt, synthetic construct
  misc_feature 1..9876: note = derived and/or modified CDS sequence (wt) from DENV-2__FJ906969__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctgtttaaaacagaggatggtgtgaacatgtgtaccctcatggccatggaccttggtgaattgtgtgaagatacaatcacgtacaagtgtccttttctcaagcagaatgaaccagaagacatagattgttggtgcaactctacgtccacatgggtaacttatgggacgtgtaccaccacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccataatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacagaagccaaacaacctgccactctaaggaagtactgtatagaggcaaagctgaccaacacaacaacagattctcgctgcccaacacaaggagaacccagcctaaatgaagagcaggacaaaaggttcgtctgcaaacactccatggtggacagaggatggggaaatggatgtggactatttggaaaaggaggcattgtgacctgtgctatgttcacatgcaaaaagaacatgaaaggaaaagtcgtgcaaccagaaaacttggaatacaccattgtgataacacctcactcaggggaagagcatgcagtcggaaatgacacaggaaaacatggcaaggaaatcaaaataacaccacagagttccatcacagaagcagagttgacaggctatggcactgtcacgatggagtgctctccgagaacgggcctcgacttcaatgagatggtgttgctgcaaatggaaaataaagcttggctggtgcacaggcaatggttcctagacctaccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggaaacttactgttcacaggacatctcaagtgcaggctgaggatggacaaactacagctcaaaggaatgtcatactctatgtgcacaggaaagtttaaagttgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacagaaaaagatagcccagtcaacatagaagcagaacctccattcggagacagctacatcatcataggagtagagccgggacaattgaagctcaactggtttaagaaaggaagttctatcggccaaatgtttgagacaacaatgaggggagcgaagagaatggccattttaggtgacacagcttgggattttggatccctgggaggagtgtttacatctataggaaaggctctccaccaagttttcggagcaatctatggggctgccttcagtggggtctcatggattatgaaaatcctcataggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaagtgtggcagtgggattttcatcacagacaacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcagccccagcccactgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaaaagcaggatgtattctgcgactcaaaactcatgtcagcggccataaaagacaacagagccgtccatgccgatatgggttattggatagaaagtgcactcaatgacacatggaagatagagaaagcctctttcatcgaagttaaaagctgccactggccaaagtcacacaccctctggagtaatggagtgttagaaagtgagatgataattccaaagaatttcgctggaccagtgtcacaacacaactacagaccaggctaccatacacaaacagcaggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccataggaatcgtactcctctcccagagcaccataccagagaccattcttgaactgactgatgcgttagccttgggcatgatggtccttaaaatggtgagaaaaatggaaaagtatcaattggcagtgactatcatggctatcttgtgcgtcccaaatgcagtgatattacaaaacgcatggaaagtgagttgcacaatattggcagtggtgtccgtttccccactgttcttaacatcctcacagcagaaagcggattggataccattagcattgacgatcaagggtctcaatccaacagctatttttctaacaaccctttcaagaaccaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaatactgaccatactcattagaacaggattgctggtgatctcaggactttttcctgtatcaataccaatcacggcagcagcatggtgcctgtgggaagtgaagaaacaacgggctggagtattgtgggatgtcccttcacccccacccgtgggaaaggctgaactggaagatggagcctatagaatcaagcaaaaagggattcttggatattcccagatcggagccggagtttacaaagaaggaacattccatacaatgtggcatgtcacacgcggcgctgttctaatgcataaaggaaagaggattgaaccatcatgggcggacgttaagaaagacctaatatcatatggaggaggctggaagctagaaggagaatggaaggaaggagaagaagtccaggtcttggcattggagcctggaaaaaatccaagagccgtccaaacaaaacctggtcttttcaaaaccaacgccggaaccataggtgccgtatctctggacttttctcctggaacctcaggatctccaatcatcgacaaaaaaggaaaagttgtgggtctttatggtaatggtgttgttacaaggagtggagcatatgtgagtgctatagcccagactgaaaaaagtattgaagacaatccagagatcgaagatgacatttttcgaaagagaaaattgaccatcatggacctccacccaggagcgggaaagacgaagagataccttccggccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataaaagcaggaaatgatatagcagcttgcctgagaaaaaatggaaagaaagtgatacaactcagtaggaagacctttgattctgagtatgtcaagactagaaccaatgattgggacttcgtggtcacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagctgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaggatctactctgacccactggcgctaaaggaattcaaggagtttgcagctggaagaaagtccctgaccctgaacctaatcacagaaatgggtaggcttccaactttcatgactcagaaggcaagagacgcactggacaacttagcagtgctgcacacggctgaagcaggtggaagggcgtacaatcatgctctcagtgaactgccggagaccctggagacattgcttttactgacacttctggctacagtcacaggaggaatctttttattcttgatgagcggaaggggtatagggaagatgaccctgggaatgtgctgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcattacaacccagcaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaagcaaccagagaagctcagaaaagagcagcagcgggcatcatgaaaaacccaactgtcgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacatttttagagggagttacttggccggagctggacttctcttttccatcatgaagaacacaaccaacacgagaaggggaactggcaacataggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctaacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgagacacaagaaagccacttacgagccagatgtagacctcggaagcggaacccgcaacatcggaattgaaagtgagataccaaacctagacataatcgggaaaagaatagaaaaaataaaacaagagcatgaaacatcatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtgacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtataacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccttgagtggagtggaaggagaagggctgcacaagctaggttacattttaagagacgtgagcaagaaagagggaggagcaatgtatgccgatgacaccgcaggatgggacacaagaatcacactagaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagtcttcaaaagcattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtacttgtagttccatgcagaaaccaagatgaactgattggtagagcccgaatttcccaaggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6501 - RNA, 9876 nt, synthetic construct
  misc_feature 1..9876: note = derived and/or modified CDS sequence (wt) from DENV-2__FJ898454__SS-prME
  source 1..9876: mol_type = other RNA
actgcaggcgtgatcatcatgctgattccaacagcgatggcgttccatttaaccacacgcaacggagaaccacacatgatcgtcagcagacaagagaaagggaaaagtctcctgtttaaaacagaagatggtgtgaacatgtgtaccctcatggccatggaccttggtgaactgtgtgaagacacaatcacttacaactgtcctcttctcaggcagaatgaaccagaagacatagattgttggtgtaactccacgtccacatgggtaacttatgggacatgcactgccacaggagaacacagaagggaaaaaagatcagtggcactcgtcccacatgtgggaatgggattggagacacgaactgaaacatggatgtcatcagaaggggcctggaaacacgcccagagaattgaaacctggatcttgagacatccaggttttaccataatggcagcaatcttggcatacaccataggaacgacatatttccaaagagtcctgatcttcatcttactgacagctgtcgctccttcaatgacaatgcgttgtattggaatatcaaatagagactttgtggaaggggtttcaggaggaagctgggttgacatagtcttagaacatggaagctgtgtgacaacgatggcaaaaaacaaaccaacattggactttgaactgataaaaacagaagccaagcaacctgccactctaaggaagtactgtatagaggcaaagctgaccaacacaacaacagcatctcgatgcccaacacaaggggaacccagcctaaatgaagaacaggacaaaaggtttgtctgcaaacattccatggtagacagaggatggggaaatggatgtggattatttggaaaaggaggcatcgtgacctgtgctatgttcacatgcaaaaaaaacatggaaggaaaaattgtgcagccagaaaacctggaatacaccattgtggtaacacctcattcaggggaagagaatgcagttggaaatgacacaggaaaacatggcaaggaaatcaaagtaacaccacagagttccattacagaagcagaactgacaggctacggcactgtcacgatggagtgctctccaagaacgggccttgacttcaatgagatggtgttgctgcaaatggaaaataaggcttggctggtgcacaggcaatggttcttagacctgccgttaccatggttgcccggagcggacacacaaggatcaaattggatacagaaggagacgttggtcaccttcaaaaatccccatgcaaagaaacaggatgttgttgttctaggatcccaagaaggggctatgcatacagcacttacaggggccacggaaatccagatgtcgtcaggaaacctactgttcacaggacatctcaagtgcaggctgagaatggacaaattacagctcaaaggaatgtcatactctatgtgtacaggaaagtttaaagttgtaaaggaaatagcagaaacacaacatggaacaatagttgtcagagtacaatatgaaggggatggctctccatgtaaaatcccttttgaaataatggatttggaaaaaagacatgtcttaggtcgcctgattacagtcaacccaattgtcacagaaaaagacagtccagtcaacatagaagcagaacctccattcggagacagctacatcattataggagtagaaccgggacaactgaagctcagctggtttaagaaaggtagctcaatcggccaaatgttcgagacaacaatgagaggagcgaagagaatggccattttaggtgacacagcctgggattttggatccctgggaggagtgttcacatctataggaaaggccctccaccaagtctttggagcaatctatggggctgccttcagtggggtctcatggactatgaaaatcctcataggagttgtcatcacatggataggaatgaattcacgtagcacctcactgtctgtgtcactagtattagtgggagtcgtgacattgtatttgggagttatggtgcaggctgatagtggttgtgttgtgagttggaaaaacaaagaactgaaatgtggcagtgggatttttatcacagacaatgtacacacatggacagaacaatacaaattccaaccagaatccccctcaaagctggcttcagctatccagaaagcttatgaagagggtatttgtggaatccgctcagtaacaagactggagaatctaatgtggaaacaaataacaccagaactgaatcacattctatcagaaaatgaggcaaagttgactatcatgacaggagacatcaaaggaatcatgcaggcaggaaaacgatccctgcggcctcagcccactgagctgaagtattcatggaaaacgtggggcaaagcgaaaatgctctccacagagcctcataaccagacctttctcattgatggccccgaaacagcagaatgtcccaacacaaacagagcttggaactcactagaagttgaagactatggctttggggtattcaccaccaacatatggctgaagttgaaagaaaggcaggatgtgttttgtgattcaaaactcatgtcagcggccataaaaaacaacagagccgtccatgccgatatgggttattggatagaaagcgcacttaatgacacatggaagatagaaaaagcttcttttatcgaagttaaaagttgccactggccaaaatcacacactctctggagtaatggagtgctagaaagtgaaatgataattccaaaaaattttgctggaccagtatcacaacacaattacagaccaggctatcacacacaaacggcaggaccctggcatctaggcaagcttgagatggactttgatttttgcgaaggaaccacagtggtggtgactgaagactgtggaaatagaggaccctctctaagaacaactaccgcttctggaaaactcataacagaatggtgctgccgatcctgcacattaccaccactaagatacagaggtgaggatggatgctggtacggaatggaaatcagaccattgaaagagaaagaagagaacttggtcaattctttggtcacagccggacatggacagattgacaacttctcactaggagtcttgggaatggcactgttcctggaagaaatgctcaggacccgagtaggaacaaaacatgcagtattactagttgcagtttctttcatgacattgatcacagggaacatgtctttccgagacctagggagagtgatggttatggtgggggctgctataacggatgacataggtatgggcgtgacttatcttgccttactagcagccttcaaagtcagaccaacttttgcagctggactgcttttgagaaagctgacctccaaggaattgatgatgaccaccataggaatcgtactcctctcccagagcaccataccagagactatacttgaattgactgatgcgttggccttgggcatgatgattctcaagatagtgagaaatatggaaaagtatcaattagcagtgactatcatggctaccttatgtgttccaaatgcagtgatattacaaaatgcatggaaagtgagctgcacaatactggcagtggtgtccgtgtccccactgctcttaacatcttcacagcagaaagcggattggataccactggcattgacgatcaaaggtctcaatccaacagctattttcctaacaactctctcaagaactaacaagaaaaggagttggccactaaatgaggctatcatggcagtcgggatggtgagcattttagccagttctctcttgaagaatgacattcccatgacaggaccattagtggctggagggcttctcactgtgtgctacgtgctcactggaagatcggccgacttggaactggagagagccgccgacgtaagatgggaagatcaggcagagatatcaggaagcagtccaattctgtcaataacaatatcggaagatggcagcatgtcgataaaaaatgaagaggaagaacaaacactgaccatactcattagaacaggattgctggtgatatcaggactttttcccgtatcaataccaatcacggcagcagcatggtacctgtgggaagtgaagaaacaacgggctggagtattgtgggatgttccttcacccccacctgtgggaaaggccgaactggaagatggagcctatagaatcaagcagaaagggattcttggatactcccagatcggagctggagtttacaaagaaggaacattccacacaatgtggcacgtcacacgtggtgctgttctaatgcacaaagggaagaggattgaaccatcatgggcggatgtcaggaaagacctaatatcgtatggaggaggctggaagctagaaggagaatggaaggaaggagaagaagtccaggtcttggcattagagcctggaaagaatccaagagccgttcaaacaaaacccggtctttttaaaactaacaccggaaccataggcgccgtgtctctagacttttctcctggaacgtcaggatctccaattgtcgacaaaaaaggaaaagtcgtgggtctctatggcaatggtgttgtcacaaggagtggaacatatgtgagtgccatagcccagactgaaaaaagcattgaagacaatccagagattgaagatgatatctttcggaaaaaaagattgaccattatggacctccacccaggagcgggaaagacgaaaagataccttccagcaatagtcagagaggctataaaacgaggcttaagaacattaatcctggcccccactagagtcgtggcagctgaaatggaagaagctcttagaggacttccgataagataccaaaccccagccattagggctgagcacactgggcgagaaatcgtggatttaatgtgtcatgccacatttaccatgaggttgttatcaccagttagagtgccaaattacaacttgatcattatggatgaagcccatttcacagacccagcaagcatagcagctagaggatacatttcaactcgagtagagatgggtgaagcagctgggattttcatgacagccactcctccgggaagcagagacccatttcctcaaagcaatgcaccaatcatggatgaagaaagggaaatccccgaacgctcgtggaactctggacatgagtgggttacagattttaaagggaagactgtctggtttgttccgagtataaaagcaggaaatgatatagcagcttgcctgagaaaaaatggaaagaaagtgatacaactcagcaggaagacctttgattctgaatacatcaagactaggaccaatgattgggactttgtggtcacgactgacatttcagaaatgggtgctaacttcaaggctgaaagggttatagaccccaggcgctgcatgaaaccagtcatactaacagacggtgaagaacgggtgatcctggcaggacccatgccagtgacccactctagtgcagcacaaagaagagggagaataggaagaaatccaaaaaatgaaaatgaccagtacatatacatgggggaacctctggaaaatgatgaagactgcgcacactggaaagaagctaagatgcttttagacaacatcaacacgcctgaaggaatcattcccagcatgttcgaaccagagcgtgaaaaggtggatgccattgatggtgaataccgcttaagaggagaagcgaggaaaacctttgtggacctaatgagaagaggagacctaccagtctggctggcctacagagtggcagccgaaggcattaactatgcagatagaaggtggtgttttgatggaatcaagaacaaccaaatcttggaagaaaatgtggaagtggaaatctggacaaaagagggggaaaggaagaaactgaaacccagatggttagatgctaggatctactctgacccactggcgctcaaagaattcaaagagttcgcagctggaagaaaatccctgaccctgaatttaatcacagaaatgggcaggcttccaacttttatgactcaaaaagcaaggaacgcactggacaacttagcagtcctgcatacggctgaagcaggcggaagggcgtacaatcatgctctcagtgaactgccagagaccctggagacattgcttttgctgacacttttggccacagtcacgggcggaatctttttattcttgatgagtggaaaaggtatagggaaaatgaccttgggaatgtgctgcataatcacggccagtattctcctatggtacgcacaaatacagccacactggatagcagcttcaataatactggagttttttctcatagtcttgctcattccagagccagaaaagcaaagaacaccccaagataaccaattgacttacgttgttatagccatcctcacagtggtggccgcaaccatggcaaacgagatggggttcctggaaaaaacgaagagagatttcggattaggaagcattgcaacccaacaacccgagagcaacatcttggacatagatttacgtcctgcatcagcatggaccctgtatgcagtggccacaacatttatcacaccaatgttgagacatagcattgaaaattcctcagtgaatgtgtctctaacagccattgccaatcaagccacagtgctaatgggtcttgggaagggatggccattgtcaaaaatggacattggagttccccttctcgccatcgggtgctattcacaagtcaatcccataaccctcacagcagcccttcttttattggtagcacattatgctatcatagggccagggctccaagcgaaagcaaccagagaagcccagaaaagagcagcggcaggcatcatgaaaaacccaactgtggatggaataacagtgattgacctagatccaataccctatgatccaaaatttgagaagcagctgggacaagtaatgctcctagtcctctgcgtgactcaagtactgatgatgaggactacatgggctttgtgtgaggctctaactttagcgaccgggcccatctccacattgtgggaaggaaatccagggagattttggaatacaaccattgcagtgtcaatggctaacatttttagaggaagttacctagctggagctggacttctcttttccatcatgaagaacacaaccaacacaagaaggggaactggcaacacaggagagacgcttggagagaaatggaaaaaccgattgaattcattggggaagagtgaattccagatctacaagagaagcggaatccaggaagtggatagaaccttggcaaaagaaggcattaaaagaggagaaacggaccatcacgctgtgtcgcgaggctcagcaaagctgagatggttcgtcgagagaaacctggttacaccagaggggaaagtagtggacctcggttgcggtagagggggctggtcatactattgtgggggtctaaagaatgtaagagaagtcaaaggcctaacaaaaggaggaccaggacacgaagaacccattcccatgtcaacatatgggtggaatcttgtgcgtctccaaagtggagttgatgttttctttactccgccagaaaagtgtgacacattgttgtgtgacataggggagtcgtcaccaaatcccacggttgaagcaggacgaacactcagagtcctaaatttggtagaaaattggctgaacaacaacacccaattttgcataaaggttcttaacccatacatgccctcagtcatagaaaaaatggaaacgctgcaaaggaaatacggaggagctttggtgaggaatccactctcaagaaattccacacatgagatgtattgggtatccaatgcttccgggaacatagtgtcatcagtgaacatgatttcaaggatgttgattaatagatttacaatgagacataagaaggccacatacgagccagatgttgacctcggaagcggaacccgcaacatcggaattgaaagtgagacaccaaacctagacataattgggaaaagaatagaaaaaataaaacaagagcatgagacatcatggcactatgaccaagaccacccatataaaacatgggcctaccatggcagctacgaaacaaaacagactggatcagcatcatccatggtgaatggagtagttagactgctgacaaaaccttgggacgtcatccctatggtgacacagatggcaatgacagacacgaccccatttggacaacagcgtgttttcaaagagaaagtggacacgagaacccaagaaccgaaagaaggcacgaagaaactaatgaaaatcacggccgaatggctctggaaagaactaggaaagaaaaagacacctagaatgtgcactagagaagaattcacaagaaaggtgagaagcaatgcagccctaggtgccatattcactgatgagaacaagtggaagtcggcacgtgaggctgttgaagacagtagattctgggaactggttgacaaggaaaggaatctccatcttgaaggaaagtgtgagacatgtgtgtacaacatgatgggaaagagagagaagaagataggggaattcggcaaagcaaaaggcagcagagccatatggtacatgtggcttggagcacgcttcttagagtttgaagccctaggattcctgaatgaagatcactggttttccagagagaactctctgagcggagtggaaggagaagggctgcacaagctgggttacattctaagagaagtgagcaagaaagaaggaggagcaatgtacgctgacgacacagcaggatgggacacaagaatcacactagaggacttaaaaaatgaagaaatggtgacaaaccacatggaaggagaacacaagaaacttgctgaggccattttcaaattaacgtaccaaaacaaggtggtgcgtgtgcaaagacccacaccaagaggcacagtaatggatattatatcgagaagggaccaaagaggtagtggacaagttggcacctatggcctcaacacctttaccaatatgggagcccaactaatcagacagatggagggagaaggagtctttaaaggcatccagcatctgacagccacagaagaagttgcagtgcaagactggttagcaagagtggggcgtgagaggttatcaagaatggccatcagtggagatgactgtgttgtgaaacccttagatgacaggtttgcaagcgctttaacagctctaaatgacatgggaaagattaggaaagacatacaacaatgggaaccttcaagaggatggaacgactggacacaagtgcctttctgttcacaccatttccatgagttaatcatgaaagacggtcgtgtgctcgtagttccatgtagaaaccaagatgaactgattggtagagctcgaatttcccagggagccgggtggtctttgcgggagacggcctgtctggggaagtcttacgcccaaatgtggagcctgatgtacttccacagacgtgacctcaggctggcggcaaacgctatttgctcggcagtcccatcacattgggttccaacaagtcgaacaacctggtccatacacgccagacatgaatggatgacaacagaagacatgctgacagtctggaacagggtgtggattcaagaaaacccatggatggaagacaaaactccagtggaatcatgggaggaaatcccatacttagggaaaagagaagaccaatggtgcggctcattgatagggttaacaagcagggccacctgggcaaagaacatccaaacagcaataaaccaagttagatccttaataggcagtgaggaatacacagactatatgccatccatgaaaagattcagaagggaagaggaagaggcaggggtcttgtggtag

SEQ ID NO: 6502 - RNA, 9876 nt, synthetic construct
  misc_feature 1..9876: note = derived and/or modified CDS sequence (wt) from DENV-2__JQ922551__SS-prME
  source 1..9876: mol_type = other RNA
actgtaggcatgatcatcatgctgattccaacagccatggcgttccatttaaccacacgcaacggagaaccacacatgatcgtcagcagacaagagaaagggaaaagtctcttgttcaaaacagaggatggtgtgaacatgtgtaccctcatggccatggaccttggtgaactgtgtgaagacacaatcacttataactgtcctcttctcaagcagaatgaaccggaagatatagattgttggtgcaactccacgtccacatgggtaacttatgggacatgcactgccacaggagaacacagaagggaaaaaagatcagtggcacttgtcccacatgtgggaatgggattggagacacgaactgaaacatggatgtcatcagaaggggcctgcaaacacgcccagagaattgaaacctggatcttaagacatccaagctttaccataatggcagcaatcttggcatacaccataggaacgacatatttccaaagagttgtgtttttgatggtactgacagcagtggctctttcaatgacaatgcgttgtataggaatatcaaatagagactttgtggaaggggtctcaggaggaagctgggttgacatagtcctagaacatggaagctgcgtgacaacgatggcaaaaaacaaaccaacattggactttgaactgataaaaacagaagccaagcaacctgccactctaaggaagtactgtatagaggcaaagctgaccaacacgacaacagcatctcgatgcccaacacaaggggaacccagcctgaatgaagagcaggacaaaaggttcgtccgcaaacattccatggtagacagaggatggggaaatggatgtggattatttggaaaaggaggcattgtgacctgtgctatgttcacatgcaaaaaaaacatggaaggaaaaatcgtgcaaccagaaaacctggaatacacccttgtgataacacctcactcaggggaagagaatgcagttggaaatgacacaggaaaccatggcaaggaaatcaaagtaacaccacagagttccattacggaagcagcactgacaggctatggcactgtcacaatggaatgctctcccagaacgggcctcaacttccatgagatggtgtcgctgccaatggaaaacaaagcttggatggtgcacaggcaatggttcctagacctaccgctgccatggctgcccggagcagacacacaaggatcaaattggatacagaaagagacattggtcactttcaaaaatccccatgcgaaaaaacaggacgttgttgtcttaggatcccaagagggggccatgcatacagcactcacaggggctacggaaatccagatgtcatcaggaaacttgctgttcacaggacatctcaagtgcaggctgagaatggacaaattacagcttaaagggatgtcatactccatgtgcacaggaaagtttaaagttgtgtggggaatagcaagaacacaacatggaacaatagttcatagagtacaatatgaaggagacggttctccatgcaaaatccctttgaatataatgggtctggaaaaaagacatgtcttaggtcggccgattacagtcaacccaattgtcacaggaaaagacagcccagtcaacatagaagcagaacctccattgggggacagctacatcattataggagtggaaccgggacaagtgaagctcacctgctcccagaagggaagctcaatcggccaaatgttcgagacaacaatgagaggagcgaagagaatggccattttaggtgacacagcctgggattttggatccctgggaggagtgttcacatccataggaaaggccctccaccaagtttttggagcaatctatggggctgccttcagtggggtctcatggactatgaaaatcctcataggagttgtcatcacatggataggaatgaattcacgtagcacctcactgtctgtgtcattagtactagtgggagtcgtgacattgtatttgggagttatggtgcaggctgatagtggttgtgttgtgagttggaaaaacaaagaactgaaatgtggcagtgggatttttgtcacagacaatgtacacacatggacagaacaatacaaattccaaccagaatccccctcaaagctggcttcagctatccagaaagctcatgaagagggcatctgtggaatccgctcagtaacaagactggagaatctaatgtggaaacaaataacaccagaactgaatcacattctatcagaaaatgaggtaaagttgactatcatgacaggagacatcaaaggaatcatgcaggcaggaaaacgatccctgcggcctcagcccactgagttgaagtattcatggaaaacatggggcaaagcgaaaatgctctccacagaacctcataaccagacctttctcattgatggccccgaaacagcagaatgtcccagcacaaacagagcttggaactcactaaaaggtggagactatggctttggggtattcaccaccaacatatggctgaagttgaaagaaaggcaggatgtgtcttgtgactcaaaactcatgtcagcggccataaaagacaacagagccgtccatgccgatatgggttattggatagaaagcgcacttaatgacacatggaagatagaaaaagcctcttttatcgaagttaaaagttgccattggccaaaatcacatactctctggagtaatggagtgctagaaagtgagatgataattccaaagaatttagctggaccagtatcacaacataattacagaccaggctatcacacacaaacggcagggccctggcatctaggcaagcttgagatggactttgatctttgcgaaggaaccacagtggtggtgactgaggactgtggaaatagaggaccctctctaagaacaactaccgcctctggaaaactcataacagaatggtgttgccgatcctgcacattaccaccgctaagatacagaggtgaggatggatgttggtacggaatggaaatcagaccattgaaagagaaagaagagaacttggtcaactctttggtcacagccgaacatgaacagattgacaacttctcactaggagtcttgggaatggcattgttcctggaagaaatgctcaggacccgagtaggaacaaaacatgcagtattactagttgcagtttctttcatgacattgatcacagggaacatgtctttccgagacctggggagagtgatggttatggtgggggctgctatgacggatgacataggtatgggcgtgacttatcttgccctactagcagctttcaaagttagaccaacttttgcagctggactacttttgagaaagctgacctccaaggaattgatgatgaccaccataggaatcgtactcctctcccagagtaccataccagagactatacttgaactgactgatgcgttggccttgggcatgatgatcctcaaaatagtgagaaatatggaaaagtatcaactagcagtgactatcatggctatcttatgtgttccaaatgcaatgatattacaaaatgcatggaaagtgagctgcacaatactggcagtggtgtccgtttccccactgctcttaacatcttcacagcagaaagcggattggataccattggcattgacgatcaaaggtctcaatccaacagccattttcctaacaaccctttcaagaaccaataagaaaaggagttggccactaaatgaggctatcatggcagtcgggatggtgagcattttagccagttctctcttgaagaatgacattcccatgacaggaccattagtggctggagggcttctcacagtgtgttacctgctccccggaagatccgctgatttggaactggagagagccgccgacctaagatgggaagatcaggcagagatatcaggaagtagtccaattctgtccataacaatatccgaagatggcagcatgtccataaaaaaccaagaggaaaaacaaacactgaccatcctcattaaaaccggattgctggtgatatccgaactctttcccgtacaaataccaatcacggcagcagcatggtacctgtgggaagtgaaaaaacaacgggctggagtattgtgggatgttccttcacccccacctgtgggaaaggccgaactggaagatggagcctatggaatcaagcagaaagggattcttggatactcccagattggggcgggagtttacaaagaaggaacattccacacaatgtggcacgtcacacggggtgctgttctaatgcataaagggaagaggattgaaccatcatgggcggatgtcagaaaagatctgatatcgtatggaggaggctggaagctagaaggagaatggaaggaaggagaagaagtccaggtcttggcattagagcctggaaagaatccaagagccgtccaaacaagacctggtctttttaaaactaacactggaaccataggcgctgtatctctagacttttctcctggaacgtcaggatctccaatcgtcgacaaaaaaggaaaagtcgtgggtctttatggcaatggtgtcgtcacaagaagtggaacatatgtgagtgccatagcccagactgaaaaaagcattgaagacaatccagagattgaagatgacatctttcggaaaaaaagattgaccattatggaccttcacccaggagcgggaaagacgaaaagataccttccagcaatagtcagagaggccataaaacgaggcttgagaacactaatcctggcccccactagagtcgtagcagctgaaatggaggaagctcttagaggacttccaataagataccaaaccccagccatcagagctgagcacactgggcgagaaatcgtggatttaatgtgtcatgccacatttaccatgaggctgctatcaccagttagagtgccaaattacaacctgatcattatggatgaagcccatttcacagatccagcaagcatagcagctagaggatacatttcaactcgagtagagatgggtgaagcagccgggattttcatgacagccactcctccgggaagcagagacccatttcctcagagcaatgcaccaatcatggacgaggaaagagaaattcctgaacgttcgtggaactctggacatgagtgggttacggactttaaaggaaagactgtttggtttgttccgagtataaaagcaggaaatgacatagcagcttgcctgagaaaaaatggaaagaaagtgatacaactcagtaggaaaacctttgattctgaatacatcaagactaggaccaatgattgggactttgtggtcacgactgatatttcagaaatgggtgctaactttaaggctgaaagggttatagaccccaggcgctgcatgaaaccagtcatactaacagacggtgaagagcgggtgatcctggcagggcccatgccagtgactcactctagtgcagcacaaagaagagggagaataggaagaaatccaaaaaatgaaaatgaccagtacatatacatgggggaacctctggaaaatgatgaagactgtgcacactggaaagaagctaagatgcttctagacaacatcaacacgcctgaaggaatcatccccagcatgttcgaaccagagcgtgaaaaggtggatgccattgatggtgaataccgcttaagaggagaagcgaggaaaacctttgtggacctaatgagaagaggagacctgccagtctggctggcctacagagtggcagccgaaggcatcaactatgcagacagaaggtggtgttttgatggaataaagaacaaccaaattttggaagaaaatgtggaagtggaaatctggacaaaagaaggggaaaagaagaaattgaaacccagatggttggatgctaggatctactctgacccgctggcgctcaaagaattcaaagagtttgcagctggaagaaaatccctgaccctgaatttaatcacagaaatgggtaggcttccaacttttatgactcagaaagcaaggaacgcactggacaacttagcagtcctgcatacggctgaagcaggcggaagggcgtacaatcatgctctcagtgaactgccagagactctggagacattgcttttgctgacacttttggctactgtcacgggcggaatctttttattcttgatgagcggaaaaggtatagggaaaatgaccctgggaatgtgctgcataatcacggccagtattctcctatggtacgcacaaatacagccacactggatagcagcttcaataatactggagttttttctcatagttttgctcatcccagagccagaaaagcagagaacaccccaagataaccaattgacttacgttgtcatagccatcctcacagcggtggccgcaaccatggcaaacgagatggggttcctggaaaaaacgaagaaagatttcggattgggaagcattgcaacccagccacccgagagtaacatcctggacatagatctacgtcctgcatcagcatggaccctgtatgccgtggccacaacatttatcacatcaatgttgagacatagcattgaaaattcctcggtgaatgtgtctctaacagccattgccaaccaagccacagtgctaatgggtcttgggaaaggatggccattgtcaaaaatggacattggagttccccttctcgccatcgggtgctattcacaagtcaaccccataactctcacagcagctctccttttattggtagcacattatgctatcatagggccaggactccaagctaaagcaaccagagaagcgcagaaaagagcagcagcaggcatcatgaaaaacccaactgtggatggaataacagtgattgacctagatccaataccctatgatccaaaatttgagaagcaactgggacaagtaatgctcctagtcctctgcgtgactcaagtactgatgatgaggactacatgggctttgtgtgaggctctaaccttagcgaccgggcccatctccacattgtgggaaggaaatccaggaagattttggaatacaactattgcagtgtcaatggctaacatttttagaggaagttacttggctggagctggacttctcttttctatcatgaagaacacaaccaacacaagaaggggaactggcaacacaggagagacgcttggagagaaatggaaaaaccgattgaatgcattggggaagagtgaattccagatctacaagaaaagcggaatccaggaagtggatagaaccttggcaaaagaaggcattaaaagaggagaaacggaccatcatgctgtgtcgcgaggctcagcaaagctgagatggttcgtcgagagaaacctggttacaccagaggggaaagtagtggacctcggttgtggcagagggggctggtcatactattgtggggggctaaagaatgtaagagaagtcaaaggcctaacaaaaggaggaccaggacacgaagaacccattcccatgtcaacatatgggtggaatctagtgcgtctccaaagtggagttgatgttttctttactccgccagaaaagtgtgacacattgctgtgtgacataggggagtcgtcaccaaatcccacggttgaagcaggacgaacactcagagtcctaaacttagtggaaaattggctgaacaacaacacccaattttgcgtaaaggttcttaacccatacatgccctcagtcatagaaaaaatggaaacgctgcaaaggaaatacggaggagctttggtgaggaatccactctcaagaaattccacacatgagatgtattgggtatccaatgcttccgggaacatagtgtcatcagtgaacatgatttcaaggatgttgatcaacagatttacaatgaggcataaaaaagccacatacgagccagatgttgaccttggaagcggaacccgcaacatcggaattgaaagtgagacaccaaacctagacataattgggaaaagaatagaaaaaataaaacaagagcatgaaacatcatggcactatgaccaagaccacccatataaaacgtgggcctaccatggcagctacgaaacaaaacagactggatcagcatcatccatggtgaatggagtagttagactgctgacaaaaccttgggacgtcatccctatggtgacacagatggcaatgacagacacgaccccatttgggcaacagcgtgttttcaaagagaaaagtgacacgagaacccaagaaccgaaagaaggcacgaagaaactaatgaaaatcacgcccaaatggctctggaaagaactaggaaagaaaaagacacccaggatgtgcactagagaagaattcacaagaaaggtgagaagcaatgcagccttaggtgccatattcactgatgagaacaagtggaagtcggcacgtgaggctgttgaagacagtagattttgggaactggttgacaaggaaaggaatctccatcttgaaggaaagtgtgagacatgtgtgtacaacatgatgggaaagagagagaagaagctaggggaattcggcaaagcaaaaggcagcagagccatatggtacatgtggcttggagcacgcttcttagagtttgaagccctaggattcttgaatgaagatcactggttttctagagagaactccctgagtggagtggaaggagaagggctgcacaagctgggttacattctaagagatgtgagcaagaaagaagggggagcaatgtacgctgacgacactgcaggatgggacacaagaatcacactagaggacttaaaaaatgaagaaatgggggccaaccacctggaaggagaacccaaaaaactttatgaggccatttttaaattaacgtaccaaaacaagggggtgcgtgtgcaaagaccaacaccaagaggcccattaatggatattatattgagaagagaccaaggaggtagtggacaagttggtacctatggcctcaacacttttaccaatatgggagcccaactaatcagacagatggagggagaaggagtcttcaaaggcatccagcacctgattgccacagaagaaattgcagtgcaagactggttggcaagagtggggcgtgagaggttttcaagaatggctatcagtggagatgattgtgttgtgaaacccttagatgacaggtttgcaagcgctttaacagctctaaatgacatgggaaaggagaggaaagtcttacaacaatgggaaccatcaagagaatggaacgattggacacaagtgcctttctgttcacaccatttccatgagttaatcatgaaagacggtcgtgtactcgtagttccatgtagaaaccaagatgaactgattggtagagcccgaatttcccagggagccgggtggtctttgcgggagacggcctgtctggggaaatcttacgcccaaatgtggagccagatgtactttcacaggcgtgacctcaggctggcggcaaacgctatttgctcagcagtcccatcacattgggttccaacaagtcgaacaacttggtccatacacgccagacatgaatggatgacaacggaagacatgttgacagtttggaacagggtgtggattcaagaaaacccatggatggaagacaaaactccagtggaatcatgggaggaaatcccatacttgggaaaaagagaagaccaatggtgcggctcattgatagggctaacaagcagggctacctgggcaaagaatatccaaacagcaataaaccaagttagatccttaataggcaatgaggaatacacagactatatgccatccatgaaaagattcagaagagaagaggaagaagcaggggtcttgtggtag

SEQ ID NO: 6503 - RNA, 9876 nt, synthetic construct
  misc_feature 1..9876: note = derived and/or modified CDS sequence (wt) from DENV-2__JQ922550__SS-prME
  source 1..9876: mol_type = other RNA
acagtaggcatgatcatcatgctgattccaacagtgatggcgtcccatttgaccacacgcaacggaggaccacacatgattgtcattggacaacagaaaaggaaaacctctttcttcaaaacaaagaagggtcacgacatgtgtaccctcatggccatggcctttggtgagttttgtgaaaacacaatcacgtataaatgtccttttctcaagcagaacgaaccagaagacatagattgttggtgcaactccacgtccacatgggtaacttatgggacatgtaccaccacaggagagcacagaagggaaaaaagatcagtggctcttgttccacacgtgggaatgggattggagacacgaactgaaacatggatgtcatcagaaggggcctggaaacatgcccagagaattgaaacttggattctgagacatccaggttttaccataatggccgcaatcctggcatacaccataggaacgacacatttccaaagagtcctgatattcatcctactgacagctatcgctccttcaatgacaatgcgctgcataggaatatcgaatagggactttgtggaaggagtgtcaggagggagttgggttgacatagttttagaacatggaagttgtgtgacgacgatggcaaaaaataaaccaacactggactttgaactgataaaaacagaagccaaacaacccgccactttaaggaagtactgcatagaggctaaactgaccaacacgacaacagactcgcgctgcccaacacaaggggaacccaccctgaatgaagagcaggacaaaaggtttgtctgcaaacactccatggtagatagaggatggggaaatggatgtggattatttggaaaaggaggcattgtgacctgtgctatgttcacatgcaaaaagaacatgaaaggaaaaattgtgcagccagaaaacctggaatacactgtcgtgataacacctcactcaggggaagaacatgcagtcggaaatgacacaggaaaacatggtaaggaagtcaagataacaccacagagctccatcacagaggcggaactgacaggctatggcactgttacgatggagtgctctccgagaacgggcctcgacttcaatgagatggtgttgctgcaaatggaagacaaagcttggctggtgcacagacaatggttcctagacctaccattgccatggctgcccggagcagacacacaaggatcaaattggatacagaaagagacattggtcaccttcaaaaatccccatgcgaaaaaacaggatgttgttgttttaggatcccaagagggggccatgcatacagcactcacaggggctacggaaatccagatgtcatcaggaaacttgctgttcacaggacatctcaaatgcaggctgagaatggacaaattacagcttaaagggatgtcatactccatgtgcacaggaaagtttaaagtcgtgaaggaaatagcagaaacacaacatggaacaatagtcattagagtacaatatgaaggagacggctctccatgcaagatcccctttgagataaaggatctggaaaaaagacatgttttgggccgcctgatcacagtcaacccaattgtaacagaaaaggacagtccagtcaacatagaagcagaacctccgttaggagacagctacatcatcataggagtggaaccaggacaattgaagctggactggttcaagaaaggaagttccatcggccaaatgtttgagaacacaatgaggggagcgaaaagaatggccattttgggtgacacagcctgggattttggatctctgggaggagtgttcacatcaataggaaaggctctccaccaggtttttggagcaatctatggggctgctttcagtggggtctcatggactatgaagatcctcataggagttatcatcacatggataggaatgaactcacgtagcacatcactgtctgtgtcactggtattagtgggaatcgtgacactatacttgggagtcatggtgcaggccgacagtggttgcggtgggtgtgagcggaaaacaaaaactaaatgtggcagtggaatattcgtcacagataacgtgcatacatggacagaacaatacaagttccaaccagaatccccttcaaaactggcttcagccatccagaaagctcatgaagagggcatctgtggaatccgctcagtaacaagactggaaaatcttatgtggaaacagataacaccagaattgaatcatattctatcagaaaatgaagtgaagctgaccatcatgacaggagacatcaaaggaatcatgcaggcaggaaaacgatctctgcgacctcaacccactgagttgaggtattcatggaaaacatggggtaaagcgaaaatgctctccacagaactccacaatcagaccttcctcattgatggtcccgaaacagcagaatgccccaacacaaacagagcttggaactcactggaagttgaggactacggctttggagtattcaccaccaatatatggctaagattgagagaaaagcaggatgtattttgtgactcaaaactcatgtcagcggccataaaggacaacagagccgtccatgctgatatgggttattggatagaaagcgcactcaatgacacatggaagatagagaaagcttctttcattgaagttaaaagttgccactggccaaagtcacacactctatggggtaatggagtgctagaaagcgagatggtaattccaaagaatttcgctggaccagtgtcacaacataataacagaccaggctattacacacaaacagcaggaccttggcatctaggcaagcttgagatggactttgatttctgcgaagggactacagtggtggtaaccgaggactgtggaaacagagggccctctttaagaacaaccactgcctcaggaaaactcataacggaatggtgttgtcgatcttgcactttaccaccccctaaatacagaggtgaggatggatgctggtacgggatggaaatcagaccattgaaagagaaagaagaaaatctggtcagttctctggttacagccggacatgggcagatcgataatttctcattaggaatcttgggaatggcactgttccttgaagaaatgctcaggactcgagtaggaacgaaacatgcaatattactagtcgcagtttctttcgtgacgttaatcacagggaacatgtcttttagagacctgggaagagtgatggttatggtaggtgccaccatgacagatgacataggtatgggtgtgacttatcttgctctactagcagctttcaaagtcagaccaacctttgcagctggactgctcttgagaaaactgacctccaaggaattaatgatgaccaccataggaatcgttctctcttcccagagtagcataccagagaccattcttgaactgactgatgcgttagctttgggcatgatggtcctcaagatggtgagaaacatggaaaaatatcagctggcagtgaccatcatggccattttgtgcgtcccaaatgctgtgatattacaaaacgcatggaaagtgagttgcacaatattggcagtggtgtctgtttcccccctgctcttaacatcctcacaacagaaagcggattggataccattagcattgacgatcaaaggtctcaatccaacagccatttttctaacaaccctctcaggaaccagcaagagaaggagctggcccttaaatgaggccatcatggcggttgggatggtgagtatcttggccagctctctcttaaagaatgacatccccatgacaggaccattagtggctggagggctccttactgtgtgctacgtgctaactgggcggtcagccgatctggaattagagagagctaccgatgtcaaatgggatgaccaggcagagatatcagggagcagtccaattttgtcaataacgatatcagaagatggcagcatgtcaataaagaatgaagaggaagagcaaacactgactatactcattagaacaggattgcttgtgatctcaggactctttccggtatcaataccaattacagcagcagcatggtacctgtgggaagtgaagaaacaacgggctggagtgttgtgggatgtcccctcaccaccactcgtgggaaaggccgaactggaagatggagcttacagaatcaagcaaaaaggaatccttggatattcccagatcggagccggagtttacaaagaaggaacatttcacacaatgtggcacgtcacacgtggcgctgtcctaatgcacaaggggaagaggattgaaccatcatgggcggacgtcaagaaagacttgatatcatatggaggaggttggaagctagaaggagaatggaaagaaggagaagaagtccaggtcttggcattggagcctgggaaaaatccaagagccgtccaaacaaaacctggcctttttagaaccaatactggaaccataggtgccgtatctctggacttttcccctgggacgtcaggatctccaatcgtcgacaaaaaaggaaaagttgtaggtctctatggcaatggtgtcgttacaaggagtggagcatatgtgagtgccatagcccagactgaaaaaagcattgaagacaatccagagattgaagatgacatctttcgaaagagaagattgactatcatggatctccacccaggagcaggaaagacaaagagatacctcccggccatagtcagagaggccataaaaagaggcttgagaacactaatcctagcccccactagagtcgtggcagctgaaatggaggaagcccttagaggacttccaataagataccaaaccccagctatcagggctgagcacaccgggcgggagattgtggacttaatgtgtcatgccacatttaccatgaggctgctatcaccaatcagggtgccaaattacaacctgatcatcatggacgaagcccattttacagatccagcaagcatagcagctaggggatacatctcaactcgagtggagatgggtgaggcagctggaatctttatgacagccactcctccgggtagcagagatccatttcctcagagcaatgcaccaattatggacgaagaaagagaaattccggaacgttcatggaactcagggcatgagtgggtcacggattttaaaggaaagactgtctggtttgttccaagcataaaaaccggaaatgacatagcagcctgcctgagaaagaatggaaagagggtgatacaactcagcaggaagacctttgattctgagtatgtcaagactagaaccaatgactgggatttcgtggttacaactgacatctcggaaatgggcgccaactttaaagctgagagggttatagaccccagacgctgcatgaaaccagttatactgacagacggcgaagagcgggtgattctggcaggacccatgccagtgacccactctagtgcagcacaaagaagagggagaataggaaggaatccaaagaatgaaaatgatcaatatatatatatgggggaacccctggaaaatgatgaagactgcgcgcactggaaggaagctaagatgctcctagataacatcaacacacctgaaggaatcattcccagcatgttcgagccagagcgtgaaaaggtggatgccattgacggtgaatatcgcttgagaggagaagcacgaaaaaccttactggagctaataagaggaggacctataccagtctacttaggctataagtggccaggcgaaggtatcaactacgcagacagtagattgtgtgttggacgaacccagaacaatcaaatcttggaagaaaatgtagaagtggaaatctggacaaaggaagggaaagggaaaaaattgaaacctagatggttggatgctaggatctactccgatccactggcgctaaaagaattcaaggaattcgcagccggaagaaagtccctaaccctgaacctaatcacagagatgggcagactcccaacttttatgactcagaaggccagagatgcactagacaacctggcggtgctgcatacggctgaagcgggtggaaaggcatacaatcatgctctcagtgaactaccggagaccctggagacattgcttttgctgacactgttggccacagtcacgggaggaatctttctattcctgatgagcggaaggggtatagggaagatgaccctgggaatgtgctgcataatcacggctagcatcctcttatggtatgcacaaatacaaccacattggatagcagcttcaataatattggagttctttctcatagtcctgctcattccagaaccagaaaagcagaggacaccccaggataatcaattgacctacgtcatcatagccatcctcacagtggtggccgcaaccatggcaaacgaaatgggttttctggaaaaaacaaaaaaagacctcggactgggaaacattgcaactcagcaacctgagagcaacattctggacatagatctacgtcctgcatcagcatggacgttgtatgccgtggctacaacatttatcacaccaatgttgagacatagcattgaaaattcctcagtaaatgtgtccctaacagccatagctaaccaagccacagtgctaatgggtctcgggaaaggatggccattgtcaaagatggacattggagttcccctccttgctattgggtgttattcacaagtcaaccccataaccctcacagcggctcttcttttattggtagcacattatgccatcataggaccgggacttcaagccaaagcaaccagagaagctcagaaaagagcagcagcgggcatcatgaaaaacccaactgtggacggaataacagtgatagatctagatccaataccctatgatccaaagtttgaaaagcagttgggacaagtaatgctcctagtcctctgtgtgacccaagtgctgatgatgaggactacgtgggctttgtgcgaagccttaactctagcaaccggacccgtctccacattgtgggaagggaatccaggaagattctggaacacaaccattctgatacaaatggcaaacattcttagagggagttacctggctggagctggacctcttttttccatcatggagaacacaaccggcccgagaagaagaactggtcaactagggagagagctgcttaggagatggaaaagcagactgaacgcattggggaaaagtgaattccagatctacaagaaaagtggaattcaagaagtggacagaaccttagcaaaagaaggcattaaaagaggagaaacggatcatcacgctgtgtcgcgaggctcagcaaaattgagatggttcgttgaaagaaatttggtcacaccagaagggaaagtagtggaccttggttgtggcagagggggctggtcatactattgtggaggattaaagaatgtaagagaagttaaaggcttaacaaaaggaggaccaggacacgaagaacctatccctatgtcaacatatgggtggaatttagtacgcttacagagcggagttgacgttttttttattccaccagagaggtgtgacacattgttgtgtgacataggggaatcatcaccaaatcccacggtagaagcgggacgaacactcagagtcctcaacctagtggaaaattggctgaacaataacacccaattttgcataaaggttcttaacccgtacatgccctcagtcattgaaaaaatggaaaccttacaacggaaatacggaggagctttggtgagaaatccactctcacggaattccacacatgagatgtactgggtgtccaatgcttccgggaacatagtgtcatcagtgaatatgatttcaagaatgctgattaacagatttaccatgagacacaagaaggccacttatgagccagatgtcgacctcggaagcggaacccgcaatattggaattgaaagtgagataccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtctttaaagagaaggtggacacgagaatccaagaaccaaaagaaggcacaaaaaaactaatgaaaattatggcagagtggctctggaaagaactaggaaagaaaaagacacctagaatgtgcaccagagaagaattcacaaaaaaggtgagaagcaatgcagccttgggggccatattcaccgatgagaacaagtggaaatcagcgcgtgaggctgttgaagacggtaggttttgggagctggttgacagggaaaggaatctccatcttgaagggaaatgtgaaacatgtgtgtacaacatgatgggaaaaagagagaaaaaactaggagagtttggcaaagcaaaaggcagcagagccatatggtacatgtggcttggagcacgcttcttagagtttgaagccctaggatttttgaatgaagaccattggttctccagagagaactccctgagtggagtggaaggagaagggctgcacaagctaggttacatcttgagagaggtgagcaagaaagaaggaggagcaatgtatgccgatgacaccgcaggctgggacacaagaatcacactaggggctttaaaaaatgaaagaaagtgtaccgaacacatggagggagaacccaggaaacctggccgaggccattttaaatggcgtaaccaaaacagggtggtgggggtgcaaggcccaacaccaggaggcacggtaatggacatcatatcgaggaagaaccaaaggggtagtggacaagttggtacctacggcctcaacactttcaccaacatggaagcacaattaattaggcaaatggagggggagggattcttcatagaacatcagcacttgacagcctcagaagaaaatgctgtgcaagattggttagcaagagtagggcgtgaaaaggtttcaagaatgcccatcagtggagatgattgtgttgtgaaacctttagatgatagatttgcaagagctctaacagctctaaatgacatgggaaaggttaggaaggacatacagcaatgggagccctcaagaggatggaacgactggacacaggtgcccttctgttcacaccattttcacgagttaattatgaaagatggtcgcacactcgtagttccatgcagaaaccaagatgaattgattggcagagcccgaatttcccagggagctgggtggtctttcggtgagactgcctgtttggggaagtcttacgcccaaatgtggagtttgattaacttccgcatacctgatctcaggctagcggcaaatgttatctgctcggtagtcccgtcacactgggttccaacaagccggacaacctggtccatacacgccaaccatgaatggatgacgacggaagacatgttgacagtttggaacagagtgtggatcctagaaaatccatggatggaagacaaaactcccgtggaatcatgggaggaaatcccatacctggaaaaaagagaagaccaatggtgtggttcactgattgggctgaccccccagccaccctgggcgaagaatatcgagacagcaataaaccaagtcagatccctcattggcaatgaggaatacatagattacttgccatccatgaaaagattcagaatagaagaggaagagtctggatttttgtggtag

SEQ ID NO: 6504 - RNA, 9876 nt, synthetic construct
  misc_feature 1..9876: note = derived and/or modified CDS sequence (wt) from DENV-2__JQ922553__SS-prME
  source 1..9876: mol_type = other RNA
actgcaggaatgatcatcatgctgattccaacagtgatggcgtttcatttgaccacacgcaacgtagaaccacccatgattttcagtagacaagaaaaagggaaaagctttttgtttaagacaaaggatggccacgacatgtgtaccttcatggccatggaccttggtgagttgtgtgaagacacaatcacgtataaatgtccttttctcaagcagaacgaaccagaagacatagattgttggtgcaactccacgtccacatgggtaacttatgggacatgtaccaccacaggagagcacagaagagaaaaaagatcagtggcgcttgttccacacgtgggaatgggattggagacacgaactgaaacatggatgtcatcagaaggggcctggaaacatgtccagagaattgaaacttggatcctgagacatccaggctttaccataatggccgcaattctggcatacaccataggaacgacgcatttccaaagagtcctgatattcatcttactgacaggggtcgctccttcaatgaggatgcgctgcataggaatatcaaatagggactttgtggaaggagtgtcaggagggagttgggttgacatagttttagaacatggaagttgtgtgacaacgatggcaaaaaataaaccaacactggaccttgaactgataaaaacagaagccaaacaacccgccactctaaggaagtactgtatagaggctaaactgaccaacacgacaacagactcgcgctgcccaacacaaggggaacccaccctgaatgaagagcaggacaaaaggtttgtctgcaaacactccatggtagacagaggatggggaaatggatgtggattatttggaaaaggagccatcgtgacctgtgctatgttcacatgcaaaaagagcatgaaaggaaaaattgtgcagccagaaaacttggaatacactgtcgtgataacacctcactcaggggaagaatatgcagtcggaaatgatacaggaaaacatggtaaggaagtcaagataacaccacagagctccatcacagaggcggaactgacaggctatggcactgttacgatggagtgctctccgagaacgggcctcgacttcaatgagatggtgttgctgcaaatggaagacaaagcttggctggtgcacagacaatggttcctagacctaccgttgccatggctgcccggagcggacacacaaggatcaaattggatacagaaagagacattggtcaccttcaaaaatccccatgcgaaaaaacaggatgttgttgtcttaggatcccaagagggggccatgcatacagcactcacaggggctacggaaatccagatgtcatcaggaaacttgctgttcacaggacatctcaaatgcaggctgagaatggacaaattacagcttaaagggatgtcatactccatgtgcacaggaaagtttaaagttgtgaaggaaatagcagaaacacaacatggaacaatagtcattagagtacaatatgaaggagacggctctccatgcaagatcccctttgagataatggatctggaaaaaagacatgttttgggccgcctgatcacagtcaacccaattgtaacagaaaaggacagtccagtcaacatagaagcagaacctccattcggagacagctacatcatcataggagtggaaccaggacaattgaagctggactggttcaagaaaggaagttccatcggccaaatgcttgagacaacaatgaggggagcgaaaagaatggccattttgggtgacacagcctgggattttggatctctgggaggagtgttcacatcaataggaaaggctctccaccaggtttttggagcaatctatggggctgctttcagtggggtctcatggactatgaagatcctcataggagttatcatcacatggataggaatgaactcacgtagcacatcactgtctgtgtcactggtattagtgggaatcgtgacactatacttgggagttatggtgcaggccgatagtggttgcgttgtgagctggaagaacaaagaactaaaatgtggcagtggaatattcgtcacagataacgtgcatacatggacagaacaatacaagttccaaccagaatccccttcaaaactggcatcagccatccagaaagctcatgaagagggcatttgtggaatccgctcagtaacaagactggaaaatcttatgtggaaacagataacactagaattgaatcatattctatcagaaaatgaagtgaagctgaccatcatgacaggagacatcaaaggaatcatgcaggtaggaaaacgatctctgcggcctcaacccactgagttgaggtattcatggaaaacatggggtaaagcgaaaatgctctccacagaactccacaatcagaccttcctcattgatggtcccgaaacagcagaatgcccaaatgcaaacagagcttggaattcactggaagttgaggactacggctttaggaagtataaaaccaaaatatggccaacattgaaagaatggcggaaagtattttgtgactcaaaactcatgtcagcggccataaaggataacagagccgtccatgctgatatgggttattggatagaaagcgcactcaatgacacatggaagatagagaaagcttctttcattgaagttaaaagttgccactggccaaagtcacacactctatggggtaatggagtgcaagaaagcgagatggtaattccaaagaatttcgctggaccagtgtcacaacataataacagaccaggctattacacacaaacagcaggaccttggcatctaggcaagcttgagatggactttgatttctgcgaagggactacagtggtggtaaccgaggactgtggaaacagagggccctctttaagaacaaccactgcctcaggaaaactcataacggaatggtgctgtcgatcttgcacattaccaccgctaagatacagaggtgaggctggatgctggtactggatggatatcagaccattgaaggagaaagaaaaaaatctggtcagttctctagttacagccggacatgggcagattgataatttctcattacgaatcttgggaatggcattgttccttgaaaaaatgctcatgactcgacttggaacgaaacatgcaatattactagtcgcagtttctttcgtgacgttaatcacaaggaacatgtcttttaaagacctgggaagagtgatggttatggtgggtgccaccatgacggatgacatgcgtatgggtgtgacttatcttgctctactaccagctttcaaagtcagacctacctttgcaactggactgctcttgagaaaactgacctccaaggaattgatgatgaccaccataggaatcgttcttttctcccagagtagcataccagagaccattcttgaactgactgatgcgttagccttgggcatgatggtcctcaagatggtgagaaacatggaaaaatatcagctggcagtgaccatcatggctattttatgcgtcccaaatgctgtgatattacagaacgcatggagagtgagttgcacaatattggcagtggtgtctgtttcccccctgttcttaacatcctcacgacagaaagcggattggataccattagcattgacgatcaaaggtctcaatccaacagccatttttctaacaaccctttcaagaaccagcaagaaaaggagctggcctttaaatgaggccatcatggcggttgggatggtgagcatcttggccagctctctcttaaagaatgacatccccatgacaggaccattagtggccggagggcttcttactgtgtgctacgtgctaactgggcggtcagccgatctggaattagagagagctgctgatgtcaaatgggatgaccaggcagagatatcagggagcagtccaattctgtcaataacaatatcagaagacggcagcatgtcaataaagaatgaagaggaagagcaaacactgactatactcatcagaacaggattacttgtgatctcaggactctttccggtatcaataccaatcacagcagcagcatggtacctgtgggaagtgaagaaacaacgggctggagtgttgtgggatgtcccctcaccaccaccagtgggaaaggctgaactggaagatggagcctacagaatccagcaaaaaggaatttttggatattcccagatcggagccggagtttacaaagaaggaaccttccccacaatgtggcacgtcacacgtggcgctgtcctaatgcataaggggaagaggattgaaccatcatgggcggacgtcaagaaagacttaatatcatatggaggaggttggaagctagaaggagaatggaaagaaggagaagaagtccaggtcttggcattggagcctgggaaaaatccaagagctgtccaaacaaaacctggcctttttaaaaccaacactggaaccataggtgccgtatctctggacttttcccctgggacgtcaggatctccaatcgtcgacaaaaaaggaaaagttgtgggtctctatggcaatggagtcgttacaaggagtggagcatatgtgagtgccatagctcagactgaaaaaagcattgaagactatccagaggttgagatggacatctttcggaagaagaggttgactatcatggatttccacccaggagcaggaaggcaaaagagatacttcccggccatagtcagagaggccataaaaagaggcttgagaacactaatcctagcccccactagagtcgtggcagctgaaatggaggaagcccttagaggacttccaataagataccaaaccccagctatcagggctgagcacactgggcgggagattgtagacttaatgtgtcatgccacatttaccatgaggctgctatcgccaatcagggtgccaaattacaacctgatcatcatggacgaagcccattttacagatccagcaagcatagcagctaggggatacatctcaactcgagtggagatgggtgaggcagctggaatctttatgacagccactcctccgggtagcagagatccatttcctcagagcaatgcaccaatcatggacgaagaaagagaaattccggaacgttcgtggaactccgggcatgagtgggtcacggattttaaaggaaagattgtttggtttgttccaagcttaaaaaccggaaaatacatagcagcttgcttgagaaagaatggaaagagggtgatacaactcagtaggaagacctttgattctgaatatgtcaagactagaaccaatgactgggatttcgtggttacaactgacatctcggaaatgggcgccaactttaaagctgagagggttatagaccccagacgctgcatgaaaccagttatactgacagacggcgaagagcgggtgattctggcaggacccatgccagtgacccactccagtgcagcacaaagaagagggagaataggaaggaatccaaagaatgaaaatgatcaatatatatatatgggggaacccttggaaaatgatgaagactgtgcgcactggaaggaagctaagatgctcctagataacatcaatacacctgaaggaatcattcctagcatgttcgagccagagcgtgaaaaggtggatgccattgacggtgaatatcgcttgagaggagaagcaaggaaaaccttactggagctaataagaggaggacctataccagtctacttaggctataagtggccaggcgaaggtatcaactacgcagacagtagattgtgttttgatggaatcaagaacaaccaaatcttggaagaaaacgtggaagtggaaatctggacaaaagaaggggaaaggaaggaattgaaacccagatggttggatgctaggatatactctgacccactggcgcttaaagaattcaaggaattcgcagccggaagaaagtccctaaccctgaacctaatcacagagatgggcagactcccaacttttatgactcagaaggccagaggtgcccttgccagtctgatggtcctgcatacggctgaagcaggcggaagggcgtacaatcatgctctcagtgaactgccagagaccctggagacattgcttttgctgacactgttggccacagtcacgggaggaatctttctattcctgatgagcggaaggggtatagggaagatgacccttggaatgtgctgcataatcacggccagcatcctcttatggtatgcacaaatacaaccacattggatagcagcttcaataatattggagttctttctcacagttttgctcattccagaaccagaaaagcagaggacaccccaagataatcaattgacctatgtcatcatagccatcctcacagtggtggccgcaaccatggcaaacgaaatgggctttctggaaaaaacaaagaaagatctcggactgggaaacattgcaactcagcaatcctgcaaaaagattttggacatatatctaggccctgctctaccatggaagttgtatgccggggggacaacatttatcacaccaatgttgagacatagcattgaaaattcctcagtaaatgtgtccctaacagccatagctaaccaagccacagtgctaatgggtctcgggaaaggatggccattgtcaaagatggacattggagtccccctccttgctattgggtgttactcacaagtcaaccccataaccctcacagcggctctttttttattggtagcacattatgccatcataggaccaggacttcaagccaaaccaaccagagaagctcagaaaagagcagcagcgggcatcatgaaaaacccaactgtggatggaataacagtgatagatctagatccaataccctatgatccaaagtttgaaaagcagttgggacaagtaatgctcctggtcctctgtgtgacccaagtgctgatgatgaggactacgtgggctttgtgtgaagctttaactctagcaaccggacccgtgtccacattgtgggaaggaaatccagggagattctggaacacaaccattgcagtgtcaatggcaaacatctttagagggagttacttggctggagctggacttctcttttctatcatgaagaacacaaccagcacgagaagaggaactggtaacataggagaaacgctaggagagaaatggaaaagcagactgaacgcattggggaaaagtgaattccagatctacaagaaaagtggaattcaagaagtggacagaaccttagcaaaagaaggcattaaaagaggagaaacggatcatcacgctgtgtcgcgaggctcagcaaaactgagatggttcgacgaaagaaatttggtcacaccagaagggaaagtagtggaccttggttgtggcagagggggttggtcattcttttgtggaggattaaagaatgtaagagaagtcaaagcattaacaataggagggccaggacacgaagaacctatcctcatgtcaacatatgggcggaatttagtacgttcccagagcggagttgtcgtttttcatactccaccagagaagtgtgacacatcgttgcgtgacataggggagtcgtcaccaaatcccacggttgaagcaggacgaacactcagagtcctaaacttggtagaaaattggctgaacaacaacacccaattttgcataaaggttcttaacccatacatgccctcagttatagaaaaaatggaagcgctgcaaaggaaatacggaggagctttggtgaggaatccactctcaagaaattccacacatgagatgtattgggtatccaatgcttccgggaacatagtgtcatcagtgaacatgatttcaaggatgttgatcaacagatttacaatgagacataaaaaagccacatacgagccagatgttgacctcggaagcggaactcgcaacatcggaattgaaagtgagacaccaaacctagacataattgggaaaagaatagaaaaaataaaacaagagcatgagacatcatggcactatgaccaagaccacccatataaaacatggggttcccatggcagctacgaaacaaaacagactggatcagcatcatccatggtgaacggagtagtcagattgctgacaaaaccctgggacgttgttccaatggtgacacagatggcaatgacagacacaactcccttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcataaaaaaggtgagaagtaatgcagccttgggggccatattcaccgatgagaacaagtggaaatcggcgcgtgaggctgttgaagatggtaggttttgggagctggttgacaaggaaaggaatctccatcttgaagggaaatgtgaaacatgtgtgtacaacatgatgggaaaaagagagaaaaaactaggagagtttggcaaagcaaaaggcagcagagccatatggtacatgtggcttggagcacgcttcttagagtttgaagccctaggatttttgaatgaagaccattggttctccagagagaactccctgagtggagtggaaggagaagggctgcacaagctaggttacatcttaagggaggtgagcaagaaagaaggaggagcaatgtatgccgatgacaccgcaggctgggacacaagaatcacactagaggatttaaaaaatgaagaaaggaagacgaaccacatggggggagaacacaggaaacttgcccgaggcatttttaaaatgaacctaacaaacaaggtggtgcgggtgcaaagaccaacaccgggaggcacgttaatggacatcatatcgagaaagacccaaaggggaagtgaacaagttggtacctatggcctcaccactttaaccaatctggaagccccacctattagacagatggagggaaaaggagttttcaaagggcatcagcaccgaacagcctcagaagaaaacgctgtgcaagattggctagcaagagtagggggtgaaaggttgtcaagattggctattagtggagatgattgtgttgtgaaacctctagatgatagatttgcaagagccctaacagctctaaatgacatgggaaaggttaggaaggacatacagcaatgggagccctcaagaggatggaacgactggacacaggtgcccttctgttcacaccattttcacgagttaattatgaaagatggtcgtacactcgtagtcccatgcagaaaccaagatgaactgattggcagagcccggatttcccagggagctgggtggtctttacgggagacggcctgtttggggaagttttacgcccaaaggtggagcttgatgtacttccacagacgtgatctcaggctagcaccaaatgccatctgctcggcagtccggacacactgggttccaacaagccggaaaacctggccaatacacgccagccatgattggatgacaacagaagtcatgctgacagtttggaacaaattgtggttccaagaaaatccatggatggaagacaaaactccagtgggattctgggaggaaattccattcctggaaaaagggaaagaccaatggggcggctcacttattgggctgacaagcagacccccctgggcgaagaacttccagccagcaataaaccaagtcagatcccttctttgcaatgaggaatccgcagatttcatgccatccatgaaaagattcagaagagaagaggaagaggcaggagttttgtggtag

SEQ ID NO: 6505 - RNA, 9876 nt, synthetic construct
  misc_feature 1..9876: note = derived and/or modified CDS sequence (wt) from DENV-2__JQ922549__SS-prME
  source 1..9876: mol_type = other RNA
actgcaggcgtgatcatcatgctgattccaacagcgatggcgttccatttaaccacacgcaacggagaaccacacatgatcgtcagcagacaagagaaagggaaaagtctcttgtttaaaacagaggatggtgtgaacatgtgtaccctcatggccatggaccttggtgaactgtgtgaagacacaatcacttataactgtcctcttctcaggcagaatgaaccagaagatatagattgttggtgtaactccacgtccacatgggtaacttatgggacatgcactgccccaggggaccacagaagggaaaaaagatcagtggcactcgtcccacatgtgggaatgggattggagacacgaactgaaacatggatgtcatcagaaggggcctggaaacacgcccagagaattgaaacctggatcttgagacatccaggttttaccataatggcagcaatcttggcatacaccataggaacgacatatttccaaagagtcctgatcctcatcttactgacagctgtcgctccttcaatgacaatgcgttgtattggaatatcaaatagagactttgtggaaggggtttcaggaggaagctgggttgacatagtcttagaacatggaagctgtgtgacaacgatggcaaaaaacaaaccaacattggactttgaactgataaaaacagaagccaagcaacctgccactctaacgaagtactgtatagaggcaaagctgaccaacacaacaacagcatctcgatgcccaacacaaggggaacccagcctaaatgaagagcagcacaaaaggttcgtctgcaaacattccatggtagacagaggatggggaaatggatgtggattatttggaaagggaggcatcgtgacctgtgctatgttcacatgcaaaaagaacatgaaaggaaaaattgtgcaaccagaaaacctggaatacaccattgtggtaacacctcactcaggggaagagaatgcagttggaaatgacacaggaaaacatggcaaggaaatcaaagtaagaccacagagttccattacagaagcagaactgacaggctatggcactgtcaccatggagtgctctccaagaacgggcttcgcattcaatgagatggtgttgctgcaaatggaaaataaagcttggctggtgcacaggcaatggttcttagacctgccgttaccatggttgcccggagcggacacacaaggatcaaattggatacagaaggagacattggtcaccttcaaaaatccccatgcgaagaaacaggatgttgttgttttaggatcccaagaaggggctatgcatacagctcttacaggggccacggaaatccagatgtcatcaggaaacctactgttcacaggacatctcaagtgcaggctgagaatggataaactacagctcaaaggaatgtcatactctatgtgtacaggaaagtttaaagttgtaaaggaaatagcagaaacacaacatggaacaatagttatcagagtacaatatgaaggggatggctctccatgtaaaatcccttttgagataatggatttagaaaaaagacttgtcttaggtcgcctgatcacagtcaacccaatcgtcacagaaaaagacagtccagtcaacatagaagcagaacctccattcggagacagctacatcattataggagtagaaccgggacaactgaagcccagctggtttaagaaaggaagctcaatccgccaaatgttcgagacaacaatgagaggagcgaagagaatggccattttaggtgacacagcctgggactttggatccctgggaggagtgttcacatctataggaaaggccctccaccaagtttttggagcaatctatggggctgccttcagtggggtctcatggactatgaaaatcctcataggagttgtcatcacatggataggaacgaattcacgtagcacctcactgtctgtgtcattagtattagtgggagtcgtgacattgtatttgggagtcatggtgcaggctgatagtggttgtgttgtgagttggaaaaacaaagaactgaaatgtggcagtgggatttttatcacagacaatgtacacacatggacagaacaatacaaattccaaccagaatccccctcaaagctggcttcagctatccagaaagctcatgaagagggcatttgtggaatccgctcagtaacaagactggagaatctaatgtggaaacaaataacaccagaactgaatcacattctatcagaaaatgaggtaaagttgactatcatgacaggagacatcaaaggaatcatgcaggcaggaaaacgatccctgcggccccagcccactgagctgaagtattcatggaaaacgtggggcaaagcgaaaatgctctccacagagcctcataaccagacctttctcattggcggccccgaaacagcagaatgtcccaacacaaacagagcttggaactcactagaagttgaagactatggctttggggtattcaccaccaacatatggctgaagttgaaagaaaggcaggatgtgttttgtgactcaaaactcatgtcagcggccataaaagacaacagagccgtccatgccgatatgggttattggatagaaagcgcacttaatgacacatggaagatagaaaaagcttcttttatcgaagttaaaagttgccactggccaaaatcacacactctctggagtaatggagtgctagaaagtgagatgataattccaaagaattttgctggaccagtatcacaacataattacagaccaggctaccacacacaaacggcaggaccctggcatctaggcaagcttgagatggactttcatttttgcgaaggaaccacagtggtggtgactgaggactgtggaaatagaggaccctctctaagaacaactaccgcttctggaaaactcataacagaatggtgttgccgatcctgcacattaccaccactaagatacagaggtgaggatggatgctggtacggaatggaaatcaggcccttggaaggggaagagggggacttggtccattctttggtcacagccggacatggacagattgacaacttctcactaggagtcttgggaatggcactgttcctggaagaaatgctcaggacccgagtaggaacaaaacatgcagtattactagttgcagtttctttcatgacattgatcacagggaacatgtctttccgagacctggggagagtgatggttatggtgggggctgctatgacggatgacataggtatgggcgtgacttatcttgccttactagcagccttcaaagttagaccaacttttgcagctggactacttttgagaaagctgacctccaaggaattgatgatgaccaccataggaatcgtactcctctcccagagcaccataccagagactatacttgaactgactgatgcgttggccttgggcaggatgattctcaagatagtgagaaatatggaaaagtatcaattagcagtgactatcatggctatcttatgtgttccaaatgcagtgatattacaaaatgcatggaaagtgagctgcacaatactggcagtggtgtccgtttccccactgctcttaacatcttcacagcagaaagcggattggataccattggcattgacgatcaaaggtctcaatccaacagccattttcctaacaaccctttcaagaactaacaagaaaaggagttggccactaaatgaggctatcatggcagtcgggatggtgagcattttagccagttctctcttggagaatgacattcccatgacaggcccattagtggctggagggcttctcactgtgtgttacgtgctcactggaagatcggctgacttggaactggagagagccgccgacgtaagatgggaagatcaggcagagatatcaggaagcagtccaattctgtcaataacaatatcggaagatggcagcatgtcgataaaatatgaagaggaagaaccaacgctgaccatactcattagaacaggattgctggtgatatcaggactttttcccgtatcaataccaatcacggcagcagcatggtacctgtgggaagtgaagaaacaacgggctggagtattgtgggatgttccttcacccccacctgtgggaaaggccgaactggaagatggagcttatagaatcaagcaaaaagggattcttggatcctcccagatcggagctcgagtttacaaagaaggaacattccacacaatgtggcacgtcacacgtggtgctgttctaatgcataaagggaagaggattgaaccatcatgggcggatgtcaggaaagacctaatatcatatggaggaggctggaaactagaaggagaatggaaggaaggagaagaagtccaggtcttggcattagagcctggaaagaatccaagagccgtccaaacaaaacccggtctttttaaaactaacaccggaaccataggcactgtgtctctagacttttctcctggaacgtcagaatctccaatcgtcgacaaaaaaggaaaagtcgtgggtctctatggcaatggtgtcgtcacaaggagtggaacatatgtgagtgccatagcccagactgaaaaaagcattgaagacaatccagagattgaagatgacatctttcggaaaaaaagattgaccattatggacctccacccaggagcgggaaagacgaaaagataccttccagcaatagtcagagaggccataaaacgaggcctaagaacattaatcctggcccccactagagtcgtggcagctgaaatggaggaagctcttagaggacttccaataagataccaaaccccagccatcagagctgagcacactgggcgagaaatcgtggatttaatgtgtcatgccacatttaccatgaggctgttatcaccagttagagtgccaaattacaacttgatcattatggatgaagcccatttcacagacccagcaagcatagcagccagaggatacatttcaactcgagtagagatgggtgaagcagctgggattttcatgacagccactcctccgggaagcagagacccatttcctcagagcaatgcaccaatcatggatgaagaaagggaaatccctgaacgttcgtggaattctggacatgagtgggttacagattttaaagggaagactgtttggtttgttccgagtataaaagcaggaaatgatatagcagcttgcctgagaaaaaatggaaagaaagtgatacaactcagtaggaagacctttgattctgaatacatcaagactaggaccaatgattgggactttgtggtcacgactgacatttcagaaatgggtgctaactttaaggctgaaagggttatagaccccaggcgctgcatgaaaccagtcatactaacagacggtgaagagcgggtgatcctggcaggacccatgccagtgacccactctagtgcagcacaaagaagagggagaataggaagaaatccaaaaaatgaaaatgaccagtacatatacatgggggaacctctggaaaatgatgaagactgcgcacactggaaagaagccaagatgcttttagacaacatcaacacgcctgaaggaatcattcctagcatgttcgaaccagagcgtgaaaaggtggatgccattgatggtgaataccgcttaagaggagaagcgaggaaaacctttgtggatctaatgagaagaggagacctaccagtctggctggcctacagagtggcagccgaaggcattaactatgcagacagaaggtggtgttttgatggaatcaagaacaaccaaatcttggaagaaaatgtggaagtggaaatctggacaaaagaaggggaaaggaagaaattgaaacccagatggttggatgctaggatctactctgacccactggcgctaaaagaattcaaagagtttgcagctggaagaaaatccctgaccctgaatttaatcacagaaatgggtaggcttccaacctttatgactcagaaagcaaggaacgcactggacaacttagcagtcctgcatacggctgaagcaggcggaagggcgtacaatcatgctctcagtgaactgccagagaccctggagacattgcttttgctgacacttttggccacagtcaccggcggaatctttttattcttgatgagtggaaaaggtatagggaaaatgaccctgggaatgtgctgcataatcacggccagtattctcctatggtacgcacaaatacagccacactggatagcagcttcaataatactggagttttttctcatagtcttgctcattccagagccagaaaagcagagaacaccccaagataaccaattgacttacgttgtcatagccatcctcacagtggtggccgcaaccatggcaaacgagatggggttcctggaaaaaacgaagaaagatttcggattgggaagcattgcaacccagcaacccgagagcaacatcctggacatagatctacgtcctgcatcagcatggaccctgtatgcagtggccacaacatttatcacaccaatgttgagacatagcattgaaaattccccagtgaatgtgtctctaacagccattgccaatcaagccacagtgttaatgggtcttgggaagggatggccattgtcaaaaatggacattggggttccccctctcgccatcgggtgctattcgcaagtcaaccccataaccctcacagcagcccttctcttattggtagcacattatgctatcatagggccaggactccaagtaaaagcaaccagagaagctcagaaaagagcagcagcgggcatcatgaaaaacccaactgtggatggaataacagtgattgacctagatccaataccctatgatccaaaatttgagaagcagctgggacaaataatgctccgagtcctctgcgtgactcaagtactgatgatgaggactacatgggctttgtgtgaggctctaaccttagcgaccgggcccatctccacattgtgggaaggaaatccagggagattggggaatacaaccattgcagtgtcaatggctaacatctttaggggaagctacttggctggagctggacttctcttttccatcatgaagaacacaacaaacacaagaagaggaactagcaacctaggagagacgcttggagagaaatggaaaaaccgattgaattcattggggaagagtgaattccagatctacaagaaaagcggaatccaggaagtggatagaaccttggcaaaagaaggcattaaaaagggagagacggaccatcacgctgtgtcacgaggctcagcaaagctgagatggttcgtcgagagaaacctggttacaccagaggggaaagtagtggacctcggttgcggtagagggggctggtcatactattgtgggggtctaaagaatgtaagagaagtcaaaggcctaacaaaaggaggaccaggacacgaagaacccattcccatgtcaacatatgggtggaatcttgtgcgtctccaaagtggagaagatgttttctttactccgccagaaaagtgtgacacattgttgtgtgacataggggagtcgtcaccaaatcccacggttgaagcaggacgaacactcagagtcctaaacatggtagaaaattggctgaacaacaacacccaattttgcataaaggttcttaacccatacatgccctcagtcatagaaaaaatggaagcgctgcaaaggaaatacggaggagctttggtgaggaatccactctcaagaaattccacacatgagatgtattgggtatccaatgcttccgggaacatagtgtcatcagtgaacatgatttcaaggatgttgatcaatagatttacaatgagacataagaaggccacatacgagccagatgttgacctcggaagcggaacccgcaacatcggaattgaaagtgagacaccaaacctagacataattgggaaaagaatagaaaaaataaaacaagagcatgagacatcatggcactatgaccaagaccacccatataaaacgtgggcctaccatggcagctacgaaacaaaacagactggatcagcatcatccctggtgaatggagtagttagactgctgacaaaaccttgggacgtcatccctatggtgacacagatggcaatgacagacacgaccccatttggacaacagcgtgttttcaaagagaaagtggacacgagaacccaagaaccgaaagaaggcacgaagaaactaatgaaaattacggccgaatggctctggaaagaactaggaaagaaaaagacacctagaatgtgcactagagaagaattctcaagaaaagtgagaagcaatgcagccttgggggccatattcactgatgagaacaaatggaagtcggcacgtgaggctgttgaagatggtagattttgggaactggttgacaaggaaaggattctccatcttgaaggaaagtgtgagacatgtgtgtacaacatgatgggaaagagagagaagaagataggggaattcggcaaagcaaaaggcagcagagccatatggtacatgtggcttggagcacgcttcttagagtttgaagccctaggattcctgaatgaagatcactggttttccagagagaactctctgagcggagtggaaggagaagggctgcacaagctgggttacattctcagagaagtgagcaagaaagaaggaggagcaatgtacgccgacgacactgcaggatgggacacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccgacaccaagaggcacagtaatggatattatatcgagaagagaccaaagaggtagtggacaagttggcacctatggcctcaacacctttaccaatatgggagcccaacttatcagacagatggagggagaaggagtctttaaaggcatccagcacctgacagccacagaagaaattgcagtgcaagactggttagcaagagtggggcgtgagaggttatcaagaatggccatcagtggagatgattgtgttgtgaaacccttagatgacaggtttgcaagcgctttaacagctctaaatgacatgggaaaggttaggaaagacatacaacaatgggaaccttcaagaggatggaacgactggacacaagtgcctttctgttcacaccatttccatgagttaatcatgaaagacggtcgtgtactcgtagttccatgtagaaaccaagatgaactgattggtagagcccgaatttcccagggagccgggtggtctttgcgggagacggcctgtctggggaagtcttacgcccaaatgtggagcctgatgtacttccacagacgtgacctcaggctggcggcaaacgctatttgctcggcagtcccatcacattgggttccaacaagtcgaacaaccaggtccatacacgccagacaagaatggatgacaacagaagtcatgctgacagtctggaacagggtgtggattcaagaaaacccatggatggaagacaaaactccagtggaatcatgggaggaaatcccatacttggggaaaagagaagaccaatggtgcggctcattgatagggctaacaagcagggccacctgggcaaagaacatccaaacagcaataaaccaagttagatccttaataggcagtgaggaatacacagactatatgccatccatgaaaagattcagaagagaagaggaagaggcaggggtcttgtggtag

SEQ ID NO: 6506 - RNA, 9876 nt, synthetic construct
  misc_feature 1..9876: note = derived and/or modified CDS sequence (wt) from DENV-2__JQ922552__SS-prME
  source 1..9876: mol_type = other RNA
actgcaggcatgatcatcatgctgattccaacagtgatggcgtttcatttgaccacacgcaacggagaaccccccatgattgtcagcagacaagagaaagggaaaagtctcttgttcaaaacagaggatggtgtgaacatgtgtgccctcatggccatggaccttggtgaacggtgtgaagacacaatcacttataactgtcctcttctcaatcagaatgaaccagaagacatagattgttggtgcaactccacgtccacatgggtaacttatgggacgtgtaccaccacaggagagctcagaagagaaaaaatatcagtggcgcttgttccacacgtgggaatgggattggagacacgaactgaaacatggatgtcatcagaaggggcctggaaacatgcccagagaattgaaatttggattctgagacatccaggctttaccataatggccgcaatcctggcatacaccataggaacgtcgcatttccaaagagtcctgatattcatcttactgacagccatcgctccctcaatgacaatgcgctgcataggaatatcaaatagggactttgtggaaggagtgtcaggagggagttgggttgacatagtcttagaacatggaagttgtgtgacgacgatggcaaaaaataaaccaacattggactttgaactgataaaaacagaagccaaacaacccgccactctaaggaagtactgtatagaggctaaactgaccaacacgacaacagactcgcgctgcccaacacaaggggaacccaccctgaacgaagagcaggacaaaaggtttgtctgcaaacactccatggtagacagaggatggggaaatggatgtggattatttggaaaaggaggcatcgtgacctgtgctatgttcacatgcaaaaagatcatgaaaggaaaaattgtgcagccagaaaacttggaatacactgtcgtgataacacctcactcaggggaagaacatgcagtcggaaatgacacaggaaaacatggtaaggaagtcaagataacaccacagagctctatcacagaggcggaactgacaggctatggcactgttacgatggagtgctctccgagaacgggcctcgacttcaatgagatggtgttgctccaaatggaagacaaagcttggctggtgcacagacaatggttcctagacctaccgctgccatggctgcccggagcagacacacaaggatcaaattggatacagaaagagacattggtcactttcaaaaatccccatgcgaaaaaacaggacgttgttgtcttaggatcccaagagggggccatgcatacagcactcacaggggctacggaaatccagatgtcatcaggaaacttgctgttcacaggacatctcaaatgcaggctgagaatggacaaattacagcttaaagggatgtcatactccatgtgcacaggaaagtttaaagtcgtgaaggaaatagcagaaacacaacatggaacaatagtcattagagtacaatatgaaggagacggctctccatgcaagatcccctttgagataatggatctggaaaaaagacatgttttgggccgcctgatcacagtcaacccaattgtaacagaaaaagacagtccagtcaacatagaagcagaacctccattcggagacagctacatcatcataggagtggaaccaggacaattgaagcttaactggttcaagaaaggaagttccattggccaaatgttagagacaacaatgaggggagcgaaaagaatggccattttgggtgacacagcctgggattttggatctctgggaggagtgttcacatcaataggaaaggctctccaccaggtttttggagcaatctatggggctgctttcagtggggtctcatggactatgaagatcctcacaggagttatcatcacatggataggaatgaactcacgtagcacatcactgtctgtgtcactagtattagtgggaatcgtgacactatacttgggagttatggtgcaggccgatagtggttgcgttgtgagctggaaaaacaaagaactgaaatgtggcagtggaatattcgtcacagataacgtgcatacatggacagaacaatacatgttccaacccgaatccccttcaaaactggcttcagccattcagaaagctcatgaagagggtatttgtggaatccgctcagtaacaagactggaaaatctcatgtggaaacagataacaccagaattgaatcacattctatcagaaaatgaagtgaagctgaccatcatgacaggagacatcaaaggaatcatgcaggtaggaaaacgatctctgcggcctcaacccactgagttgaggtattcatggaaaacatggggccaaccgaaaatgctctccccagaactccaccatcagacctttctcattgatggtcccgaaacagcagaatgccccaacacaaacaggacttgggattcattggaagttgaggactacggctttggagtattcaccaccaaaatatggctaagattgagagaaaagcaggatgtattttgtgactcaaaactcatgtcagcggccataaaggacaacagagccgtccatgctgatatgggttattggatagaaagcgcactcaatgacacatggaagatagagaaagcttctttcattgaagttaaaagttgccactggccaaagtcacacactctatggagtatgggagtactagaaagcgagatggtaattccaaagaatttcgctggaccagtgtcacaacataaccacaggccaggcattcccacccaaacagcaggaccttggcatctaggcaaacttgagatggactttgatttctgcgaagggactacagtggtggtaaccgaggactgtggaaacagagggccctctttaagaacaagtaccgcctctggaaaactcataacggaatggtgctgtcgatcttgcacgttaccaccgctaagatacagaggtgaggatggatgctggtatgggatggaaatcagaccattaaaagagaaagaagaaaatctggtcagttctctggtcacagccggacatgggcagattgataatttctcattaggaatcttgggaatggcattgttccttgaagaaatgctcaggactcgagtaggaacgaaacatgcaatattactagtcgcagtttctttcgtgacattaatcacagggaacatgtctggcagagacctgggaagagtgatggttatggtgggtgccaccatgacagatgacataggtatgggtgtgacttatctcgctctactagcagctttcaaagtcagaccaacctttgcagctggactgctcttgagaaaactgacctccaaggaattaatgatgaccaccataggaatcgttcttctctcccaaagtagcataccagagaccattcttgaactgactgatgcgttagctttgggcatgatggtcctcaagatggtgagaaacatggaaaaatatcagctggcagtgaccatcatggccattttatgcgtcccaaatgctgtgatattacagaacgcatggaaagtgagttgcacaatattggcattggtgtctgtttcccccctgttcttaacatcctcacaacagaaagcggattggataccattagcattgacgatcaaaggtctcaatccaacagccatttttctaacaaccctctcaagaaccagcaagaaaaggagctggcctttaaatgaggccatcatggcggttgggatggtgagcatcttggccagctctctcttaaagaatgacatccccatgacaggaccattagtggctggaggtcttctaactgtgtgctatgtgctaactgggcggtcagccgatctagaattagagagagctgccgatgtcaaatgggatgaccaggcagagatatcagggagcagtccaattctgtcaataacaatatcagaagatggcagcatgtcaataaagaatgaagaagaagagcaaacactgactatactcattagaacagaattgctggtgatatcaggactttttcccatatcaataccaatcacggcagcagcatggtacctgtgggaagtgaagaaacaacgggctggagtattgtgggatgttccttcacccccacctgtgggaaaggccgaactggaagatggagcttatagaatcaagcaaaaaggaattcttggatattcccagatcggagccggagtttacaaagaaggaacatttcacacaatgtggcacgtcacacgtggcgctgtcctaatgcataaggggaagaggattgaaccatcatgggcggacgtcaagaaagacttaatatcatatggaggaggttggaagctagaaggagaatggaaagaaggagaagaagtccaggtcctggcattggagcctgggaaaaatccaagagccgtccaaacaaagcctggcctttttaaaaccaacaccggaaccataggtgccgtatctctggacttttcccctgggacgtcaggatctccaatcgtcgacaaaaaaggaaaagttgtgggtctctatggcaatggtgtcgttacaaggagtggagcatatgtgagtgccatagctcagactgaaaaaagcattgaagacaatccagagattgaggatgacatctttcgaagaaagaagttgactatcatggatctccacccaggagcaggaaagacaaaaagatacctcccggccatagtcagggaggctataaaaagaggcttgagaacactaatcctagcccccactagagtcgtggcagccgaaatggaggaagcccttagaggacttccaataagataccaaaccccagctatcagggctgagcacaccgggcgggagattgtggacttaatgtgtcatgccacatttaccatgaggctgctatcaccaatcagggtgccaaattacaacctgatcatcatggacgaagcccattttacagatccagcaagcatagcagctaggggatacatctcaactcgagtggagatgggtgaggcagctggaatctttatgacagccactcctccgggtagcagagatccatttcctcagagtaatgcaccaattatggacgaagaaagagaaattccggaacgttcgtggaactccggacatgagtgggtcacggattttaaaggaaagactgtttggtttgttccaagcataaaaaccggaaatgacatagcagcctgcctgagaaagaatggaaagagggtgatacaactcagtaggaagacctttgattctgaatatgtcaagactagaaccaatgactgggatttcgtggtcacaactgacatctcggaaatgggcgccaactttaaagctgagagggttatagaccccagacgctgcatgaaaccagttatactgacagacggcgaagagcgggtgattctggcaggacccatgccagtgacccactctagtgcagcacaaagaagagggagaataggaaggaatccaaagaatgaaaatgatcaatatatatatatgggggaacccttggaaaatgacgaagactgtgcgcactggaaggaagctaagatgctcctagataacatcaacacacctgaaggaatcattcctagcatgttcgagccagagcgtgaaaaggtggatgccattgacggtgaatatcgcttgagaggagaagcaaggaaaacttttgtggacctaatgagaagaggagacctaccagtctggctggcctacagagggccagccgaaggcattaactatgcagacagaaggtggtgttttgatggaatcaagaacagccaattcttggaagaaaatgtggaagtggaaatctggccatctggaggggaaaggaaggaattgaaacccagatggttggatgctaggatatactctgacccactggcgcttaaagaattcaaggagtttgcagctggaagaaaatccctgaccctgaatttaatcacagaaatgggtaggcttccaacctttatgactcagaaagcaaggaacgcactggacaacttagcagtcctgcatacggctgaagcaggcggaagggcgtacaatcatgctctcagtgaactgccagagaccctggagacattgcttttgctgacacttttggccacagtcacgggtggaatttttctattcctgatgagcggaaggggtatagggaagatgaccctgggaatgtgctgcataatcacggccagcatcctcttatggtatgcacaaatacaaccacattggatagcagcttcaataatattggagttctttctcatagtcttgctcattccagaaccagaaaagcaaaggacaccccaggataaccaattgacctatgtcatcatagccatcctcacagtggtagccgcaaccatggcaaacgaaatgggtttcctggaaaaaacaaagaaagatctcggactgggaaacatagtaactcagcaacctgagagcaacattctggacatagatctacgtcctgcatcagcatggacgttgtatgccgcggctacaacatttatcacaccaatgttgagacatagcattgaaaattcctcagtaaacatgtccctaacagccattgctaaccaagccacagtactaatgggtctcgggaaaggatggccattgtcaaagatggacattggagttcccctccttgctattgggtgttactcacaagtcaaccctataaccctcacagcggctctttttttattggtagcccattatgccatcaaaggaccgggacttcaagccaaagcaaccagagaagctcagaaaagagcagcagcgggcatcatgaaaaacccaactgtggatggaataacagtgatagatctagatccaataccctatgatccaaagtttgaaaaacagttgggacaagtaatgctcttagtcctctgtgtgacccaagtgctgatgatgaggactacgtgggctttgtgtgaagccttaactctagcaaccggacccgtatccacattgtgggaaggaaatccagggagattctggaacacaaccattgcagtgtcaatggcaaacatctttagagggagttacctggctggatctagccaggtctggccttccattaataatcttaagggaggtaggagaggtacgggagctcaaggggaaacattgggagaaaaatggaaaagacaactaaaccaactgagcaagtcagaatttaacacttacaaaaggagtggaattatggaggtggacagatctgaagccaaggagggactgaaaagaggagaaacaaccaaacatgcagtgtcgagaggaacagccaaacttaggtggtttgtggagaggaaccttgtgaaaccagaagggaaagtgatagacctcggttgtgggagaggtggctggtcatattactgcgccgggctgaagaaggttacagaagtgaagggatacacaaaaggaggacccggtcatgaggaacctatcccaatggcgacttatggatggaacctagtgaagctacactccggaaaggatgtattctttacaccaccagagaagtgtgacacattgttgtgtgacataggggaatcatcaccaaatcccacggtagaagcgggacgaacactcagagtccttaacctagtagaaaattggctgaacaataacacccaattttgcataaaggtccttaacccgtacatgccctcagtcattgaaaaaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacttatgaaccagatgtcgacctcggaagcggaacccgcaatattggaattgaaagtgagacaccgaacctagacataattggaaaaagaatagaaaaaataaaacaagagcacgaaacgtcatggcactatgaccaagaccacccatacaaaacatgggcttaccatggcagctatgaaacaaaacagactggatcagcatcatccatggtgaacggagtagtcagactgctgacaaaaccctgggacgttgttccaatggtgacacagatggcaatgacagacacaactcctttcggacaacagcgcgtcttcaaggagaaggtggatacgagaacccaagaaccaaaagaaggcacaaaaaaattaatgaaaatcacggcagaatggctctggaaagaactaggaaagaaaaagacacctagaatgtgccccagagaagaattcacaaaaaaggtgagaagtaatgcagccttgggggccatattcaccgatgcgaccaagtggaaatcggcgcgtgaggctgttgaagatggcaggttttgggagctggttgacaaggaaaggaatctccatcttgaagggaaatgtgaaacatgtgtgtacaacatgatgggaaaaagagagaaaaaactaggagagtttggcaaagcaaaaggcagcagagccatatggtacatgtggcttggagcacgcttcttagagtttgaagccctaggatttttgaatgaagaccattggttctccagagagaactccctgagtggagtggaaggagaagggctgcacaagctaggttacatcttaagagaggtgagaaagaaagaaggaggagcaatgtatgccgatgactccgcaggctgggacacaagaatcacactagaggatttaaaaaatgaagaaaggataacgaaccacatggaggtagaacacaaaaaacttgccgtaggccattttatattgacgtacccaaacaaggtggtgcgtgtgcaaagaccaacaccagtaggcacggtaatggacatcatatcgaggaagagtcaaaggggtagtggacaagttggtacctatggcctcaatactttcaccaacctggaagggccacgaattaggcaaatggagggggaggaatctttcaaaagccatcagctccagacagccacagaaagaaatgctgtgcaagattggctagcaagagtagggcgtgaaaggttatcaagaatggccatcagtggagatgattgtgttgtgaaacctctagatgatagatttgcaagagccctaacagctcttaatgacatgggaaaggttaggaaggacatacaacaatgggagccctcaagaggatggaacgactggacacaggtgcccttctgttcacaccattttcacgagttaattatgaaagatggtcgcacactcgtagttccatgtagaaaccaagatgaattgattggtagagcccgaatttcccagggagctgggtggtctttacgggagacggcctgtctggggaagtcttacgcccaaatgtggagcttgatgtactttcacagacgtgatctcaggctagcggcaaatgccatctgctcggcagtcccgtcacactgggttccaacaagccggacaacctggtccatacacgccagccatgaatgggtggcgacggaagacatgttgacagtttggaacagagtgtggatccaagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaatcaagtcagatccctcattggcaatgaggaatacacagattacatgccatccatgaaaagattcagaagagaagaggaagaggcaggagttttgtggtag

SEQ ID NO: 6507 - RNA, 9876 nt, synthetic construct
  misc_feature 1..9876: note = derived and/or modified CDS sequence (wt) from DENV-2__GU131896__SS-prME
  source 1..9876: mol_type = other RNA
tctgcaggcatgatcattatgctgattccaacagtgatggcgttccatctaaccacacgtaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctctgctcaggcagaatgagccagaagacatagactgttggtgcaactccacgtccacgtgggtaacctatgggacttgtactaccacgggagaacatagaagagaaaaaagatcagtggcactcgttccacatgtgggaatgggactggagacgcgaaccgaaacatggatgtcgtcagaaggggcttggaaacatgcccagagaattgaaacttggatcctaagacatccaggcttcaccataatggcagcaatcttggcatacaccatagggacgacacatttccagagagccctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaatacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacagggaaacacggcaaggaaatcaaagtaacaccacagagttccatcacagaagctgaattgacaggttatggcaccgtcacgatggaatgctctccgagaacaggcctcgacttcaatgagatggtgttgctgcagatggaaaataaagcttggctggtgcataggcaatggttcctagacctgccattaccgtggctgcccggagcggacaaacaagggtcaaattggatacagaaagaaacattggtcactttcaaaaatccccatgcaaagaaacaggatgttgttgttttaggatctcaagaaggggccatgcatacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttattagattgcaatacgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcaaagagaatggccattttgggtgacacagcctgggacttcggctccctaggaggagtgtttacatctgtaggaaaagctctccaccaaatctttggagcaatctatggagctgccttcagtggggtttcatggactatgaaaatcctcataggagtcattatcacatggataggaatgaactcacgcagcacttcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccccgagacggcagaatgccctaacacaaatagagcttggaactcgttggaggttgaagactacggctttggagtgttcaccaccaatatatggctaaaattgaaagagaaacaggatgcattctgcgactcaaaactcatgtcagcagccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataatcccaaagaatctcgctggaccagtgtctcaacacaactatagaccaggctaccacacacaaacagcaggaccatggcatctaggcaagcttgagatggactttgatttctgcgatggaaccacagtgatagtgaccgaggactgcggaaatagaggaccctctttgagaacaactactgcctctggaaaactcataacagaatggtgctgccgatcttgcacactaccacccctaagatacagaggtgaggatgggtgctggtacgggatggaaatcagaccattgaaagagaaagaagaaaatctggttaattctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccattcttgaattgactgatgcgttagccttaggcatgatggtcctcaaaatagtaagagacatggaaaagtatcaattagcagtgactattatggctatcttgtgcgtcccaaacgcagtgatattacagaatgcatggaaagtgagttgcacaatactggcagtggtgtccgtttccccactgcttttgacatcttcacagcaaaaaacggattggataccattagcattgacaattaagggtctcaatccaacagccatctttctaacaaccctctcaagaaccaacaagaaaaggagctggccactaaatgaggccatcatggcagtcggaatggtgagcattctagccagttccctcctgaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcatcagaacaggattgctggtgatctcaggactttttcccgtatcaataccaatcacggcagcagcatggtacctgtgggaagtgaagaaacaacgggccggagtattgtgggacgttccctcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgttcaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccaataagataccaaaccccagctatcagagctgagcacactgggcgggaaattgtggatttaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgagcgttcatggaattctggacatgagtgggttacggattttaaagggaagactgtttggttcgttccaagcataaaagcaggaaatgacatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgacagggttatagaccccagacgctgcatgaaaccagtcatactaacagatggtgaggagcgggtgattctggcaggacctatgccagtaacccactctagtgcagcacaaagaagagggagaataggaagaaatccaaaaaatgaaaatgaccagtacatatacatgggagaacctctggaaaatgatgaagactgtgcacactggaaagaagccaaaatgctcctagacaacattaacacaccagaaggaatcattcccagtatgttcgaaccagaacgtgaaaaagtggatgccattgatggcgaataccgcttgagaggagaagcaaggaaaacctttgtggacttaatgaggagaggagacctaccagtctggttggcttacaaagtggcagctgaaggcatcaactatgcagacagaaggtggtgttttgatggaataaagaacaaccaaatcctggaagaaaatgtggaagttgaaatctggacaaaagaaggagaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgctcttactgacacttctggctacagtcacaggagggatctttttattcttgatgagcgggaggggcatagggaagatgaccctgggaatgtgctgcataatcacggctagcatccttctttggtacgcacaaatacagccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcctggacgctgtatgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaatccaactgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccatcgcggtgtcaatggctaacatctttagagggagttacttggctggagctggacttctcttttccattatgaagaacacaaccaacacaagaaggggaactggcaacataggagagacgcttggagagaaatggaaaagccgattgaatgcactgggaaaaagtgaattccagacctacaagaaaagtggaatccaggaagtggatagaaccttagcaaaagaaggcatcaagagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtctccagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcggtgaacatgatttcaaggatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcacgaaacatcatggcactacgatcaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaattaatgaaaatcacagcagaatggctgtggaaagaattagggaagaaaaagacacctaggatgtgcaccagagaagaattcacaagaaaggtgagaagcaatgcagccttgggggccatattcactgacgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtacgccgacgacacagcaggatgggacacaagaatcacactagaagacttaaaaaacgaagaaatggtaacaaaccacatggaaggagaacacaaaaaattagccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagccacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcctttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggctaacaagcagggccacatgggcaaagaacatccaagcagctataaatcaagttagatctcttataggcaatgaggaatacacagattacatgccatccatgaaaagattcagaagagaagaggaagaagcaggagtcctgtggtaa

SEQ ID NO: 6508 - RNA, 9876 nt, synthetic construct
  misc_feature 1..9876: note = derived and/or modified CDS sequence (wt) from DENV-2__GU131897__SS-prME
  source 1..9876: mol_type = other RNA
tctgcaggcatgatcattatgctgattccaacagtgatggcgttccatctaaccacacgcaatggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcggcaatcctggcatacaccatagggacgacacatttccagagagtcctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtgacacctcactcaggggaagagcatgcggtcggaaatgacacaggaaaacacggcatggaaatcaaagtaacaccacagagctccatcacagaagcagaattgacaggttatggcaccgtcacgatggagtgctccccgagaacaggcctcgacttcaatgagatggtgttactgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactctatgtgcacaggaaagtttaaagttgtgaaggaaatagcagaaacacaacatggaacgatagttatcagagtgcaatatgaaggggacggctctccatgcaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatccataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcattacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaaccatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccctgagacggcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacactaccacccctaagatacagaggtgaggatgggtgctggtacgggatggaaatcagaccattgaaagagaaagaagaaaatctgattaactccttggtcacagccggacatgggcaggttgacaatttttcactaggagtcttgggaatggcattattcctggaggaaatgcttaggacccgagtaggaacgaaacatgcaatactactagttgcagtttcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactacttttgacatcctcacagcaaaaaacggattggataccattagcattgacaatcaagggtctcaatccaacagccatttttttaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacagcagcagcatggtacctgtgggaagtgaagaaacaacgggccggagtattgtgggacgttccttcacccccacccatgggaaaggctgaactggaagatggagcctacagaatcaagcaaaaagggattcttggatactctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattgaagacaaccccgagatcgaagatgacattttccgaaagagaagactgaccatcatggacctccacccaggagccggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcctccgggaagtagagatccatttccccagagcaatgcaccaatcatagatgaagaaagagaaatccctgaacgttcatggaattctggacatgagtgggtcatggattttaaagggaagactgtttggttcgttccaagcataaaagcaggaaatgatatagcagcttgcctgaggaaaaatggaaagaaagtaatacaacttagtagaaagacctttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaacgtggaagttgaaatctggacaaaagaaggggaaaggaagaaattgaaacccagatggttggatgctaggatctactctgacccactggcgctaaaagaattcaaagaatttgcagccggaagaaagtctctgactctgaacctaatcacagaaatgggtaggcttccaacattcatgactcagaagacaagagatgcactggacaacctagcagtgctgcacacggctgaagcaggtggaagggcgtacaatcatgctctcagtgaactaccggagaccctagagacactgcttttactgacacttctggctacagtcacaggagggatctttttattcttgatgagtgggaggggcatagggaagatgaccctaggaatgtgctgcataatcacggctagcatccttctatggtacgcacaaatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcttagaaaaaacgaagaaagatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctattattggtagcgcattatgccatcatagggccaggacttcaagcaaaagcaaccagagaagcccagaaaagagcagcggcaggcatcatgaaaaacccaaccgtcgatggaataacagtgattgatctagatccaataccttatgatccaaagtttgaaaagcagttaggacaagtaatgctactaatcctctgcgtgactcaagtattgatgatgaggaccacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagaaacgcttggagagaaatggaaaagccgattgaacgcactgggaaaaagtgaattccaaatctacaagaaaagtggaatccaggaagtggatagaaccttagcaaaagaaggcatcaaaagaggagaaacggaccatcatgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaacgcttctgggaacatagtgtcatcagtgaacatgatttcaaggatgttgatcaatagattcacaatgagacacaagaaagctacttacgagccggatgttgacctcggaagcggaacccgtaacattggaattgaaagtgaaataccaaacttagacataattgggaaaagaatagaaaaaataaaggaagagcatgaaacatcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttatattctaagagacgtgagcaagaaagagggaggagccatgtacgccgacgacacagcaggatgggacacaagaatcacactagaagacctaaaaaatgaagaaatggtaacaaaccacatggaaggagaacataagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagctgccgtgcaaaactggttggctagagtggggcgcgaaaggttgtcaagaatggccatcagtggagatgattgtgttgtgaaacctttagatgacaggttcgcaaacgctttgacagctctgaatgacatgggaaagattagaaaagacatacaacaatgggaaccttcaaaaggatggaacgattggacacaagtgcccttctgttcacaccatttccatgagctaatcatgaaggatggtcgtgtacttgttgttccatgtagaaatcaagatgaactgattggcagagcccgaatctcccaaggagcagggtggtctttgcgggagacggcctgtttggggaagtcttacgcccaaatgtggagcttaatgtatttccacaggcgtgacctcaggctggcggcaaatgccatttgctcggcagtgccatcacactgggttccaacaagtcgaacaacctggtccatacacgctaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagttctgtggtaa

SEQ ID NO: 6509 - RNA, 9876 nt, synthetic construct
  misc_feature 1..9876: note = derived and/or modified CDS sequence (wt) from DENV-2__GQ868631__SS-prME
  source 1..9876: mol_type = other RNA
tctgcaggcatgatcattatgctgattccaacagtgatggcgttccatctaaccacacgcaatggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactaagggagaacatagaagagaaaaaagatcagtggcactcgttccacatgtgggaatgggactggagacgcgaactgaaacatggatgtcatcagaaggggcttggaaacatgcccagagaattgaaacttggatcctaagacatccaggcttcaccataatggcggcaatcctggcatacaccatagggacgacacatttccagagagtcctgattttcatcctactgacagctgtcgctccttcaatgacaatgcgctgcataggaatatcaaatagagactttgtagaaggggtttcaggaggaagttgggttgacatagtcctagaacatggaagctgtgtgacgacgatggcaaaaaacaaaccaacattggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattgtttggaaagggaggcattgtgacctgtgctatgttcacatgcaaaaagaacatggaagggaaaatcgtgcaaccagaaaacttggaatacaccattgtggtgacacctcactcaggggaagagcatgcggtcggaaatgacacaggaaaacacggcatggaaatcaaagtaacaccacagagctccatcacagaagcagaattgacaggttatggcaccgtcacgatggagtgctccccgagaacaggcctcgacttcaatgagatggtgttactgcagatggaaaataaagcttggctggtgcacaggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttactcttcactggacatctcaagtgcaggctgagaatggacaagctacagcttaaaggaatgtcatactctatgtgcacaggaaagtttaaagttgtgaaggaaatagcagaaacacaacatggaacgatagttatcagagtgcaatatgaaggggacggctctccatgcaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatccataggaaaagctctccaccaagtctttggagcaatctatggagttgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaattgaaatgtggcagtgggattttcattacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaaccatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccctgagacagcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcacctaggcaagcttgagatggactttgatttctgcgatggaaccacagtgatagtgactgaggactgcggaaatagaggaccctctttgagaacaactactgcctctggaaaactcataacagaatggtgctgccgatcttgtacattaccacccctaagatacagaggtgaggatgggtgctggtacgggatggaaatcagaccattgaaagagaaagaagaaaatctggttaactccttggtcacagccggacatgggcaggtagacaatttttcactaggagtcttgggaatggcattattcctggaggaaatgcttaggacccgagtaggaacgaaacatgcaatactactagttgcagtctcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatggctaccataggaattgtactcctctcccaaagcactataccagagaccgttcttgaactgactgatgcgttagccttaggcatgatggccctcaaaatagtaagaaacatggaaaagtatcaattagcagtgactatcatggctatcttgtgcgtcccaaacgcagtgatattacaaaatgcatggaaagtaagttgcacaatactggcagtggtgtccgtttccccactacttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgcttactggacgatcggccgacttggaactggagagagcaaccgatgtcaaatgggaagaccaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctatatcaataccaatcacagcagcagcgtggtacctgtgggaagtgaagaaacaacgggccggagtattgtgggacgttccttcacccccacccatgggaaaggctgaactggaagatggagcctacagaatcaaacaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcctccgggaagtagagatccatttccccagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgaggaaaaatggaaagaaagtaatacaacttagtagaaagacctttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacatcaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaacgtggaagttgaaatctggacaaaagaaggggaaaggaagaaattgaaacccagatggttggatgctaggatctactctgacccactggcgctaaaagaattcaaagaatttgcagccggaagaaagtctctgactctgaacctaatcacagaaatgggtaggcttccaacattcatgactcagaagacaagagatgcactggacaacctagcagtgctgcacacggctgaagcaggtggaagggcgtacaatcatgctctcagtgaactaccggagaccctagagacactgcttttactgacacttctggctacagtcacaggagggatctttttattcttgatgagtgggaggggcatagggaagatgaccctaggaatgtgctgcataatcacggctagcatccttctatggtacgcacaaatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcttagaaaaaacgaagaaagatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctattattggtagcgcattatgccatcatagggccaggacttcaagcaaaagcaaccagagaagcccagaaaagagcagcggcaggcatcatgaaaaacccaaccgtcgatggaataacagtgattgatctagatccaataccttatgatccaaagtttgaaaagcagttaggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagaaacgcttggagagaaatggaaaagccgattgaacgcactgggaaaaagtgaattccaaatctacaagaaaagtggaatccaggaagtggatagaaccttagcaaaagaaggcatcaaaagaggagaaacggaccatcatgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcaatgcaaaggaaatatggaggagccttagtgagaaatccactctcacggaactccacacatgagatgtactgggtatccaacgcttctgggaacatagtgtcatcagtgaacatgatttcaaggatgttgatcaatagattcacaatgagacacaagaaagctacttacgagccggatgttgacctcggaagcggaacccgtaacattggaattgaaagtgaaataccaaacttagacataattgggaaaagaatagaaaaaataaaggaagagcatgaaacatcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttatattctaagagacgtgagcaagaaagagggaggagccatgtacgccgacgacacagcaggatgggacacaagaatcacattagaagacctaaaaaatgaagaaatggtaacaaaccacatggaaggagaacataagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagttacagaagaagctgccgtgcaaaactggttggctagagtggggcgcgaaaggttgtcaagaatggccatcagtggagatgattgtgttgtgaaacctttagatgacaggttcgcaaacgctttgacagctctgaatgacatgggaaagattagaaaagacatacaacaatgggaaccttcaaaaggatggaacgattggacacaagtgcccttctgttcacaccatttccatgagctaatcatgaaggatggtcgtgtacttgttgttccatgtagaaatcaagatgaactgattggcagagcccgaatctcccaaggagcagggtggtctttgcgggagacggcctgtttggggaagtcttacgcccaaatgtggagcttaatgtatttccacaggcgtgacctcaggctggcggcaaatgccatttgctcggcagtgccatcacactgggttccaacaagtcgaacaacctggtccatacacgctaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacattcaagcagcaataaatcaggttagatctcttataggcaatgaggaatacacagattacatgccatccatgaaaagattcagaagagaagaggaagaggcaggagttctgtggtaa

SEQ ID NO: 6510 - RNA, 9876 nt, synthetic construct
  misc_feature 1..9876: note = derived and/or modified CDS sequence (wt) from DENV-2__GU131899__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgctggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtattgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtgacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcacttttaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagccatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctcattcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagccgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctattatggcagtcggaatggtgagcattttagccagttccctcctaaaaaatgatattcccatgacaggaccactagtggctggagggctcctcactgtgtgctacgtgctcactggacgatcggccgacttggaactagagagagcaaccgatgtcaaatgggaagaccaggcagagatatcaggaagcagtccaatcctgtcgataacaatatcagaagatggtagtatgtcgataaaaaatgaagaggaagaacaaacactgaccatactcattagaacaggattgctggtgatctcaggactttttcctatatcaataccagtcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcacaaaggaaagaggattgaaccttcatgggcggacgtcaaaaaagatctaatatcatatggaggaggctggaagctagaaggagaatggaaggaaggagaagaagtccaggtgctggcactggagcctggaaagaatccaagagccgtccaaacaaaacctggtcttttcaaaaccaacaccggaacaataggtgctgtatctttggacttttcccctggaacgtcaggatctccaatcatcgacaaaaaaggaaaagttgtgggtctctatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgatcatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtgatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacattggaaagaagccaaaatgctcctagataacattaacacaccagaaggaatcattcctagtatgtttgaaccagagcgtgaaaaggtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatatggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttatttttgatgagcgggaggggcatagggaagatgaccctgggaatgtgctgcataatcacggctagcatacttctatggtacgcacaaatacagccacattggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggactaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggaccacatgggctctgtgtgaggccttaaccttagctacagggcccatctccacactgtgggaaggaaatccaggaaggttctggaacactaccattgcggtgtcaatggccaatatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagagaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagctacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagcaggttttgggagctggttgacaaggaaaggaatctccatcttgaaggaaagtgtgagacatgtgtgtacaacatgatgggaaaaagagaaaagaagctaggggaattcggcaaggcaaaaggtagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatgaaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgtcccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagatatgttgacagtctggaacagggtatggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagactacatgccatccatgaaaagattcagaagagaagaggaagaggcaggagtcctgtggtaa

SEQ ID NO: 6511 - RNA, 9876 nt, synthetic construct
  misc_feature 1..9876: note = derived and/or modified CDS sequence (wt) from DENV-2__GU131900__SS-prME
  source 1..9876: mol_type = other RNA
tctgcaggcatgatcattatgctgattccaacagtgatggcgttccatctaaccacacgcaatggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcggcaatcctggcatacaccatagggacgacacatttccagagagtcctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtgacacctcactcaggggaagagcatgcggtcggaaatgacacaggaaaacacggcatggaaatcaaagtaacaccacagagctccatcacagaagcagaattgacaggttatggcaccgtcacgatggagtgctccccgagaacaggcctcgacttcaatgagatggtgttactgcagatggaaaataaagcttggctggtgcataggcaatggtttctagacctgccattaccatggctgcccggagcggataaacaagagtcaaattggatacagaaagaaacattggttactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactctatgtgcacaggaaagtttaaagttgtgaaggaaatagcagaaacacaacatggaacgatagttatcagagtgcaatatgaaggggacggctctccatgcaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatccataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcattacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaaccatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccctgagacagcagagtgccccaacacaaatagagcttggaactcgttggaggttgaagattacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgtacattaccacccctaagatacagaggtgaggatgggtgctggtacgggatggaaatcagaccattgaaagagaaagaagaaaatctggttaactccttggtcacagccggacatgggcaggttgacaatttttcactaggagtcttgggaatggcattattcctggaggaaatgcttaggacccgagtgggaacgaaacatgcaatactactagttgcagtttcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactacttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaagatgatattcccatgacaggaccactagtggctggagggctcctcactgtgtgctacgtgcttactggacgatcggccgacttggaactggagagagcaaccgatgtcaaatgggaagaccaggcagagatatcaggaagcagtccaattctgtcaataacaatatcagaagatggtagcatgtcgataaaaaacgaagaggaagaacaaacactgaccatactcattagaacaggattgctggtgatctcaggactttttcctatatcaataccaatcacagcagcagcgtggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcctccgggaagtagagatccatttccccagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgaggaaaaatggaaagaaagtaatacaacttagtagaaagacctttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaacgtggaagttgaaatctggacaaaagaaggggaaaggaagaaattgaaacccagatggttggatgctaggatctactctgacccactggcgctaaaagaattcaaagaatttgcagccggaagaaagtctctgactctgaacctaatcacagaaatgggtaggcttccaacattcatgactcagaagacaagagatgcactggacaacctagcagtgctgcacacggctgaagcaggtggaagggcgtacaatcatgctctcagtgaactaccggagaccctagagacactgcttttactgacacttctggctacagtcacaggagggatctttttattcttgatgagtgggaggggcatagggaagatgaccctaggaatgtgctgcataatcacggctagcatccttctatggtacgcacaaatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcttagaaaaaacgaagaaagatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttattcacaagtcaatcccataactctcacagcagctctcctattattggtagcgcattatgccatcatagggccaggacttcaagcaaaagcaaccagagaagcccagaaaagagcagcggcaggcatcatgaaaaacccaaccgtcgatggaataacagtgattgatctagatccaataccttatgatccaaagtttgaaaagcagttaggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagaaacgcttggagagaaatggaaaagccgattgaatgcactgggaaaaagtgaattccaaatctacaagaaaagtggaatccaggaagtggatagaaccttagcaaaagaaggcatcaaaagaggagaaacggaccatcatgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacacttagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaacgcttctgggaacatagtgtcatcagtgaacatgatttcaaggatgttgatcaatagattcacaatgagacacaagaaagctacttacgagccggatgttgacctcggaagcggaacccgtaacattggaattgaaagtgaaataccaaacttagacataattgggaaaagaatagaaaaaataaaggaagagcatgaaacatcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttatattctaagagacgtgagcaagaaagagggaggagccatgtacgccgacgacacagcaggatgggacacaagaatcacattagaagacctaaaaaatgaagaaatggtaacaaaccacatggaaggagaacataagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagctgccgtgcaaaactggttggctagagtggggcgcgaaaggttgtcaagaatggccatcagtggagatgattgtgttgtgaaacctttagatgacaggttcgcaaacgctttgacagctctgaacgacatgggaaagattagaaaagacatacaacaatgggaaccttcaaaaggatggaacgattggacacaagtgcccttctgttcacaccatttccatgagctaatcatgaaggatggtcgtgtacttgttgttccatgtagaaatcaagatgaactgattggcagagcccgaatctcccaaggagcagggtggtctttgcgggagacggcctgtttggggaagtcttacgcccaaatgtggagcttaatgtatttccacaggcgtgacctcaggctggcggcaaatgccatttgctcggcagtgccatcacactgggttccaacaagtcgaacaacctggtccatacacgctaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaggcaggagttctgtggtaa

SEQ ID NO: 6512 - RNA, 9876 nt, synthetic construct
  misc_feature 1..9876: note = derived and/or modified CDS sequence (wt) from DENV-2__GU131901__SS-prME
  source 1..9876: mol_type = other RNA
tctgcaggcatgatcattatgctgattccaacagtgatggcgttccatctaaccacacgcaatggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcggcaatcctggcatacaccatagggacgacacatttccagagagtcctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtgacacctcactcaggggaagagcatgcggtcggaaatgacacaggaaaacacggcatggaaatcaaagtaacaccacagagctccatcacagaagcagaattgacaggttatggcaccgtcacgatggagtgctccccgagaacaggcctcgacttcaatgagatggtgttactgcagatggaaaataaagcttggctggtgcataggcaatggtttctagacctgccattaccatggctgcccggagcggataaacaagagtcaaattggatacagaaagaaacattggttactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactctatgtgcacaggaaagtttaaagttgtgaaggaaatagcagaaacacaacatggaacgatagttatcagagtgcaatatgaaggggacggctctccatgcaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatccataggaaaagctctccaccaagtctttggagcaatctatggagctgccttcagtggggtttcatggaccatgaaaatcctcataggagttattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcattacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaaccatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccctgagacagcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgcgggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgtacattaccacccctaagatacagaggtgaggatgggtgctggtacgggatggaaatcagaccattgaaagagaaagaagaaaatctggttaactccttggtcacagccggacatgggcaggttgacaatttttcactaggagtcttgggaatggcattattcctggaggaaatgcttaggacccgagtaggaacgaaacatgcaatactactagttgcagtttcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactacttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggcaggagggctcctcactgtgtgctacgtgcttactggacgatcggccgacttggaactggagagagcaaccgatgtcaaatgggaagaccaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctatatcaataccaatcacagcagcagcgtggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcctccgggaagtagagatccatttccccagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgaggaaaaatggaaagaaagtaatacaacttagtagaaagacctttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaacgtggaagttgaaatctggacaaaagaaggggaaaggaagaaattgaaacccagatggttggatgctaggatctactctgacccactggcgctaaaagaattcaaagaatttgcagccggaagaaagtctctgactctgaacctaatcacagaaatgggtaggcttccaacattcatgactcagaagacaagagatgcactggacaacctagcagtgctgcacacggctgaagcaggtggaagggcgtacaatcatgctctcagtgaactaccggagaccctagagacactgcttttactgacacttctggctacagtcacaggagggatctttttattcttgatgagtgggaggggcatagggaagatgaccctaggaatgtgctgcataatcacggctagcatccttctatggtacgcacaaatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcttagaaaaaacgaagaaagatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctattattggtagcgcattatgccatcatagggccaggacttcaagcaaaagcaaccagagaagcccagaaaagagcagcggcaggcatcatgaaaaacccaaccgtcgatggaataacagtgattgatctagatccaataccttatgatccaaagtttgaaaagcagttaggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacgtaggagaaacgcttggagagaaatggaaaagccgattgaacgcactgggaaaaagtgaattccaaatctacaagaaaagtggaatccaggaagtggatagaaccttagcaaaagaaggcatcaaaagaggagaaacggaccatcatgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactttcacggaactccacacatgagatgtactgggtatccaacgcttctgggaacatagtgtcatcagtgaacatgatttcaaggatgttgatcaatagattcacaatgagacacaagaaagctacttacgagccggatgttgacctcggaagcggaacccgtaacattggaattgaaagtgaaataccaaacttagacataattgggaaaagaatagaaaaaataaaggaagagcatgaaacatcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttatattctaagagacgtgagcaagaaagagggaggagccatgtacgccgacgacacagcaggatgggacacaagaatcacattagaagacctaaaaaatgaagaaatggtaacaaaccacatggaaggagaacataagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagctgccgtgcaaaactggttggctagagtggggcgcgaaaggttgtcaagaatggccatcagtggagatgattgtgttgtgaaacctttagatgacaggttcgcaaacgctttgacagctctgaacgacatgggaaagattagaaaagacatacaacaatgggaaccttcaaaaggatggaacgattggacacaagtgcccttctgttcacaccatttccatgagctaatcatgaaggatggtcgtgtacttgttgttccatgtagaaatcaagatgaactgattggcagagcccgaatctcccaaggagcagggtggtctttgcgggagacggcctgtttggggaagtcttacgcccaaatgtggagcttaatgtatttccacaggcgtgacctcaggctggcggcaaatgccatttgctcggcagtgccatcacactgggttccaacaagtcgaacaacctggtccatacacgctaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaggcaggagttctgtggtaa

SEQ ID NO: 6513 - RNA, 9876 nt, synthetic construct
  misc_feature 1..9876: note = derived and/or modified CDS sequence (wt) from DENV-2__GU131902__SS-prME
  source 1..9876: mol_type = other RNA
tctgcaggcatgatcattatgctgattccaacagtgatggcgttccatctaaccacacgcaatggagaaccacacatgatcgtcggtatacaggagaaagggaaaagtcttctgttcaaaacagaggatggtgtgaacatgtgcaccctcatggctatggaccttggtgaattgtgtgaggacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcggcaatcctggcatacaccatagggacgacacatttccagagagtcctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattgtttggaaagggaggcattgtgacctgtgctatgttcacatgcaaaaagaacatggaagggaaaatcgtgcaaccagaaaacttggaatacaccattgtggtgacacctcactcaggggaagagcatgcggtcggaaatgacacaggaaaacacggcatggaaatcaaagtaacaccacagagctccatcacagaagcagaattgacaggttatggcaccgtcacgatggagtgctccccgagaacaggcctcgacttcaatgagatggtgttactgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaaatgcaggctgagaatggacaagctacagcttaaaggaatgtcatactctatgtgcacaggaaagtttaaagttgtgaaggaaatagcagaaacacaacatggaacgatagttatcagagtgcaatatgaaggggacggctctccatgcaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaaactcaactggttcaagaaaggaagttctatcggccaaatgtttgagacaacgatgagaggggcgaagagaatggccattttgggtgacacagcctgggacttcggatccctgggaggagtgtttacatccataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcattacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaaccatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccctgagacagcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcatagcagaatggtgctgccgatcttgtacattaccacccctaagatacagaggtgaggatgggtgctggtacgggatggaaatcagaccattgaaagagaaagaagaaaatctggttaactccttggtcacagccggacatgggcaggttgacaatttttcactaggagtcttgggaatggcattattcctggaggaaatgcttaggacccgagtaggaacgaaacatgcaatactactagttgcagtttcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactacttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgcttactggacgatcggccgacttggaactggagagagcaaccgatgtcaaatgggaagaccaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctatatcaataccaatcacagcagcagcgtggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggcacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcctggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcctccgggaagtagagatccatttccccagagcaatgcaccaatcatagatgaagaaagagaaatccctgaacgttcatggaattctggacatgagtgggttacggattttaaagggaagactgtttggttcgttccaagcataaaagcaggaaatgatatagcagcttgcctgaggaaaaatggaaagaaagtaatacaacttagtagaaagacctttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtagatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaacgtggaagttgaaatctggacaaaagaaggggaaaggaagaaattgaaacccagatggttggatgctaggatctactctgacccactggcgctaaaagaattcaaagaatttgcagccggaagaaagtctctgactctgaacctaatcacagaaatgggtaggcttccaacattcatgactcagaagacaagagatgcactggacaacctagcagtgctgcacacggctgaagcaggtggaagggcgtacaatcatgctctcagtgaactaccggagaccctagagacactgcttttactgacacttctggctacagtcacaggagggatctttttattcttgatgagtgggaggggcatagggaagatgaccctaggaatgtgctgcataatcacggctagcatccttctatggtacgcacaaatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcttagaaaaaacgaagaaagatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctattattggtagcgcattatgccatcatagggccaggacttcaagcaaaagcaaccagagaagcccagaaaagagcagcggcaggcatcatgaaaaacccaaccgtcgatggaataacagtgattgatctagatccaataccttatgatccaaagtttgaaaagcagctaggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagaaacgcttggagagaaatggaaaagccgattgaacgcactgggaaaaagtgaattccaaatctacaagaaaagtggaatccaggaagtggatagaaccttagcaaaagaaggcatcaaaagaggagaaacggaccatcatgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaacgcctctgggaacatagtgtcatcagtgaacatgatttcaaggatgttgatcaatagattcacaatgagacacaagaaagctacttacgagccggatgttgacctcggaagcggaacccgtaacattggaattgaaagtgaaataccaaacttagacataattgggaaaagaatagaaaaaataaaggaagagcatgaaacatcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaagtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttatattctaagagacgtgagcaagaaagagggaggagccatgtacgccgacgacacagcaggatgggacacaagaatcacactagaagacctaaaaaatgaagaaatggtaacaaaccacatggaaggagaacataagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaacactttcaccaatatggaagcccaattaatcagacagatggagggagaaggagtctttaaaaacatccagcacctgacagtcacagaagaagctgccgtgcaaaactggttggctagagtggggcgcgaaaggttgtcaagaatggccatcagtggagatgattgtgttgtgaaacctttagatgacaggttcgcaaacgctttgacagctctgaatgacatgggaaagattagaaaagacatacaacaatgggaaccttcaaaaggatggaacgattggacacaagtgcccttctgttcacaccatttccatgagctaatcatgaaggatggtcgtgtacttgttgttccatgtagaaatcaagatgaactgattggcagagcccgaatctcccaaggagcagggtggtctttgcgggagacggcctgtttggggaagtcttacgcccaaatgtggagcttaatgtatttccacaggcgtgacctcaggctggcggcaaatgccatttgctcggcagtgccatcacactgggttccaacaagtcgaacaacctggtccatacacgctaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaggcaggagttctgtggtaa

SEQ ID NO: 6514 - RNA, 9876 nt, synthetic construct
  misc_feature 1..9876: note = derived and/or modified CDS sequence (wt) from DENV-2__GU131924__SS-prME
  source 1..9876: mol_type = other RNA
tctgcaggcatgatcattatgctgattccaacagtgatggcgttccatctaaccacacgcaatggagaaccacacatgatcgtcggcatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcggcaatcctggcatacaccatagggacgacacatttccagagagtcctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtgacacctcactcaggggaagagcatgcggtcggaaatgacacaggaaaacacggcatggaaatcaaagtaacaccacagagctccatcacagaagcagaattgacaggttatggcaccgtcacgatggagtgctccccgagaacaggcctcgacttcaatgagatggtgttactgcagatggaaaataaagcttggctggtgcataggcaatggtttttagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactctatgtgcacaggaaagtttaaagttgtgaaggaaatagcagaaacacaacatggaacgatagttatcagagtgcaatatgaaggggacggctctccatgcaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcattacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccctgagacggcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgtacattaccacccctaagatacagaggtgaggatgggtgctggtacgggatggaaatcagaccattgaaagagaaagaagaaaatctggttaactccttggtcacagccggacatggacaggttgacaatttttcactaggagtcttgggaatggcattattcctggaggaaatgcttaggacccgagtaggaacgaaacatgcaatactactagttgcagtttcttttgtgacattgatcacagggaatatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactacttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacagcagcagcatggtacctgtgggaagtgaagaagcaacgggccggagtattgtgggacgttccttcacccccacccatgggaaaggctgaactggaagatggagcctacagaatcaagcaaaaagggattcttggatattctcagattggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcctccgggaagtagagatccatttccccagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgaggaaaaatggaaagaaagtaatacaacttagtagaaagacctttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactacgcagacagaaggtggtgttttgatggaattaagaacaaccaaatcctggaagaaaacgtggaagttgaaatctggacaaaagaaggggaaaggaagaaattgaaacccagatggttggatgctaggatctactctgacccactggcgctaaaagaattcaaagaatttgcagccggaagaaagtctctgactctgaacctaatcacagaaatgggtaggcttccaacattcatgactcagaagacaagagatgcactggacaacctagcagtgctgcacacggctgaagcaggtggaagggcgtacaatcatgctctcagtgaactaccggagaccctagagacactgcttttactgacacttctggctacagtcacaggagggatctttttattcttgatgagtgggaggggcatagggaagatgaccctaggaatgtgctgcataatcacggctagcatccttctatggtacgcacaaatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcttagaaaaaacgaagaaagatcttggattaggaagcattgcaacccagcaacctgagagcaacatcctggacatagatctacgtcccgcatcagcttggacgctgtatgccgtggctacaacattcgttacaccaatgctgagacatagcattgagaattcctcagtgaatgtatccttaacagctatagccaaccaagcaacagtgttaatgggtctagggaaaggatggccattgtcaaagatggacatcggagttccccttctcgccattggatgttactcacaagtcaatcccataactctcacagcagctctcctattattggtagcgcattatgccatcatagggccaggacttcaagcaaaagcaaccagagaagcccagaaaagagcagcggcaggcatcatgaaaaacccaaccgtcgatggaataacagtgattgatctagatccaataccttatgatccaaagtttgaaaagcagttaggacaagtaatgctactaatcctctgcgtgactcaagtattgatgatgaggactacatgggctctgtgtgaggccttaaccttggctacagggcccatctccacactgtgggaaggaaatccaggaaggttctggaacactaccattgcggtgtcaatggctaacatctttagagggagttacttggctggagctggacttctcttttcaattaagaagaacacaaccaacacaagaaggggaactggcaacataggagaaacgcttggagagaaatggaaaagccgattgaacgcactgggaaaaagtgaattccaaatctacaagaaaagtggaatccaggaagtggatagaaccttagcgaaagaaggcatcaaaagaggagaaacggaccatcatgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaacgcttctgggaacatagtgtcatcagtgaacatgatttcaaggatgttgatcaatagattcacaatgagacacaagaaagctacttacgagccggatgttgacctcggaagcggaacccgtaacattggaattgaaagtgaaataccaaacttagacataattgggaaaagaatagaaaaaataaaggaagagcatgaaacatcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagagaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttatattctaagagacgtgagcaagaaagagggaggagccatgtacgccgacgacacagcaggatgggacacaagaatcacactagaagacctaaaaaatgaagaaatagtaacaaaccacatggaaggagaacataagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtttttaaaaacatccagcacctgacagtcacagaagaagctgccgtgcaaaactggttggctagagtggggcgcgaaaggttgtcaagaatggccatcagtggagatgattgtgttgtgaaacctttagatgacaggttcgcaaacgctttgacagctctgaatgacatgggaaagattagaaaagacatacaacaatgggaaccttcaaaaggatggaacgattggacacaagtgcccttctgttcacaccatttccatgagctaatcatgaaggatggtcgtgtacttgttgttccatgtagaaatcaagatgaactgattggcagagcccgaatctcccaaggagcagggtggtctttgcgggagacggcctgtttggggaagtcttacgcccaaatgtggagcttaatgtatttccacaggcgtgacctcaggctggcggcaaatgccatttgctcggcagtgccatcacactgggttccaacaagtcgaacaacctggtccatacacgctaaacatgaatggatgacaacggaagatatgctgacagtctggaacagggtgtggattcgagagaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagttctgtggtaa

SEQ ID NO: 6515 - RNA, 9876 nt, synthetic construct
  misc_feature 1..9876: note = derived and/or modified CDS sequence (wt) from DENV-2__GQ868638__SS-prME
  source 1..9876: mol_type = other RNA
tctgcaggcatgatcattatgctgattccaacagtgatggcgttccatctaaccacacgtaacggagaaccacacatgatcgtcggtatacaggagaaagggaaaagtcttctgttcaaaacagaggatggtgtgaacatgtgcaccctcatggctatggaccttggtgaactgtgtgaagacacaatcacgtacaagtgtcctctgctcaggcagaatgagccagaagacatagactgttggtgcaactccacgtccacgtgggtaacctatgggacttgtactaccacgggagaacatagaagagaaaaaagatcagtggcactcgttccacatgtgggaatgggactggagacgcgaaccgaaacatggatgtcgtcagaaggggcttggaaacatgcccagagaattgaaacttggatcctaagacatccaggcttcaccataatggcagcaatcttggcatacaccatagggacgacacatttccagagagccctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaatacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacagggaaacacggcaaggaaatcaaagtaacaccacagagttccatcacagaagctgaattgacaggttatggcaccgtcacgatggaatgctctccgagaacaggcctcgacttcaatgagatggtgttgctgcagatggaaaataaagcttggctggtgcataggcaatggttcctagacctgccattaccgtggctgcccggagcggacaaacaagggtcaaattggatacagaaagaaacattggtcactttcaaaaatccccatgcaaagaaacaggatgttgttgttttaggatctcaagaaggggccatgcatacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttattagattgcaatacgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcaaagagaatggccattttgggtgacacagcctgggacttcggctccctaggaggagtgtttacatctgtaggaaaagctctccaccaaatctttggagcaatctatggagctgccttcagtggggtttcatggactatgaaaatcctcataggagtcattatcacatggataggaatgaactcacgcagcacttcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagccatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccccgagacggcagaatgccctaacacaaatagagcttggaactcgttggaggttgaagactacggctttggagtgttcaccaccaatatatggctaaaattgaaagagaaacaggatgcattctgcgactcaaaactcatgtcagcagccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataatcccaaagaatctcgctggaccagtgtctcaacacaactatagaccaggctaccacacacaaacagctggaccatggcatctaggcaagcttgagatggactttgatttctgcgatggaaccacagtgatagtgaccgaggactgcggaaatagaggaccctctttgagaacaactactgcctctggaaaactcataacagaatggtgctgccgatcttgcacactaccacccctaagatacagaggtgaggatgggtgctggtacgggatggaaatcagaccattgaaagagaaagaagaaaatctggttaattctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggtgccaccatgacggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccattcttgaattgactgatgcgttagccttaggcatgatggtcctcaaaatagtaagagacatggaaaagtatcaattagcagtgactattatggctatcttgtgcgtcccaaacgcagtgatattacagaatgcatggaaagtgagttgcacaatactggcagtggtgtccgtttccccactgcttttgacatcttcacagcaaaaaacggattggataccattagcattgacaattaagggtctcaatccaacagccatctttctaacaaccctctcaagaaccaacaagaaaaggagctggccactaaatgaggccatcatggcagtcggaatggtgagcattctagccagttccctcctgaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcatcagaacaggattgctggtgatctcaggactttttcctgtatcaataccaatcacggcagcagcatggtacctgtgggaagtgaagaaacaacgggccggagtattgtgggacgttccctcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgttcaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccaataagataccaaaccccagctatcagagctgagcacactgggcgggaaattgtagatttaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagagatccctgagcgttcatggaattctggacatgagtgggttacggattttaaagggaagactgtttggttcgttccaagcataaaagcaggaaatgacatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgacagggttatagaccccagacgctgcatgaaaccagtcatactaacagatggtgaggagcgggtgattctggcaggacctatgccagtaacccactctagtgcagcacaaagaagagggagaataggaagaaatccaaaaaatgaaaatgaccagtacatatacatgggagaacctctggaaaatgatgaagactgtgcacactggaaagaagccaaaatgctcctagacaacattaacacaccagaaggaatcattcccagtatgttcgaaccagaacgtgaaaaagtggatgccattgatggcgaataccgcttgagaggagaagcaaggaaaacctttgtggacttaatgaggagaggagacctaccagtctggttggcttacaaagtggcagctgaaggcatcaactatgcagacagaaggtggtgttttgatggaataaagaacaaccaaatcctggaagaaaatgtggaagttgaaatctggacaaaagaaggagaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagcgaactgccggagaccctagagacactgctcttactgacacttctggctacagtcacaggagggatctttttattcttgatgagcgggaggggcatagggaagatgaccctgggaatgtgctgcataatcacggctagcatccttctttggtacgcacaaatacagccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcctggacgctgtatgccgtggctacaacatttgttacaccaatgctaagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcacagaaaagagcagcggcgggcatcatgaaaaatccaactgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcagtgtcaatggctaacatctttagagggagttacttggctggagctggacttctcttttccattatgaagaacacaaccaacacaagaaggggaactggcaacataggagagacgcttggagagaaatggaaaagccgattgaatgcactgggaaaaagtgaattccagacctacaagaaaagtggaatccaggaagtggatagaaccttagcaaaagaaggcattaagagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtctccagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgtataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcggtgaacatgatttcaaggatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcacgaaacatcatggcactacgatcaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagagcccaagaaccgaaagaaggcacgaagaaattaatgaaaatcacagcagaatggctgtggaaagaattagggaagaaaaagacacctaggatgtgcaccagagaagaattcacaagaaaggtgagaagcaatgcagccttgggggccatattcactgacgagaacaagtggaagtcggcacgtgaggctgttgaagatagtaggttttgggagctggttgacaaggaaaggaatctccatcttgaaggaaagtgtgagacatgcgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtacgccgacgacacagcaggatgggacacaagaatcacactagaagacttaaaaaacgaagaaatggtaacaaaccacatggaaggagaacacaaaaaattagccgaggctattttcaaactaacgtatcaaaacaaggtggtgcgtgtgcaaagaccaacaccaagaggcacagtaatggacatcatatcgagaagagaccaaagaggtagtgggcaagttggcacctatggactcaatactttcaccaatatggaagcccaattaatcagacagatggagggagaaggagtctttagaaacatccagcacctgacagccacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcctttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtattttcacaggcgtgacctcaggctggcggcaaatgccatttgctcggcagtgccatcacactgggttccaacaagtcgaacaacctggtccatacacgccaaacatgaatggatgactacggaagacatgctgacagtctggaacagggtgtggattcgagaaaatccatggatggaagacaaaaccccagtggaatcatgggaggaaatcccatacttgggaaaaagagaagaccaatggtgcggctcattgattgggctaacaagcagggccacatgggcaaagaacatccaagcagccataaatcaagttagatctcttataggcaatgaggaatacacagattacatgccatccatgaaaagattcagaagagaagaggaagaagcaggagtcctgtggtaa

SEQ ID NO: 6516 - RNA, 9876 nt, synthetic construct
  misc_feature 1..9876: note = derived and/or modified CDS sequence (wt) from DENV-2__GU131927__SS-prME
  source 1..9876: mol_type = other RNA
tctgcaggcatgatcatcatgctgattccaacagtgatggcgttccatctaaccacacgcaacggagaaccacacatgatcgtcggcatacaggagaaagggaaaagccttctgttcaaaacagaggatggtgtgaacatgtgcaccctcatggctatggaccttggtgaactgtgtgaagacacaatcacgtacaagtgtcctcttctcaggcagaatgagccagaagacatagactgttggtgcaactccacgtctacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcattctactgacagctgtcgctccttcaatgacaatgcgttgcataggaatttcaaatagagattttgtagaaggggtttcaggaggaagttgggttgacatagtcttagaacatggaagctgtgtgacgacgatggcaagaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggacaagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccatagtggtaacacctcactcaggggaagagcatgcggtcggaaatgacacaggaaaacacggcaaggaaatcaaagtaacaccacagagttccatcacagaagcagaattgacaggttatggcaccgtcacgatggagtgctctccgagaacaggcctcgacttcaatgagatggtgttgctacagatggaaaataaagcttggctggtgcataggcaatggttcctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctctttactggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccatttggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtatttacatctgtgggaaaagctctccaccaagtctttggagcaatctatggagctgccttcagtggggtttcatggactatgaaaatcctcataggagtcattatcacatggataggaatgaactcacgcagcacctcactgtctgtgtcactagtactggtgggtattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaactatcatgacaggagacatcaaaggaatcatgcaggcaggaagacgatctttgcggcctcagcctactgagctaaagtattcatggaaaacatggggtaaagcaaaaatgctctccacagagtcttataaccaaacctttctcattgatggccccgagacgacagagtgccccaacgcgaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaagcctctttcattgaagtaaaaaactgccactggccaaaatcacacaccctctggagcaatggagtgctagaaagtgagatgataattccaaagagtctcgctggaccagtgtctcaacacaactatagaccaggctaccatacacaaatagcaggaccatggcatctaggtaagcttgagatggactttgacttctgcgatggaaccacagtgatagtgactgaggactgcggaaatagaggaccctctttgagaacaactactgcctctggaaaactcataacagaatggtgctgccgatcctgcacattaccacccctaagatacagaggtgaggatgggtgctggtacgggatggaaatcagaccattgaaagagaaagaagaaaatctggttaactccttggtcacagctggacatgggcaggttgacaatttttcactgggagtcctgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgaccaccataggaattgtactcctctcccaaagcactataccagagaccattcttgaattgactgatgcgttagccttaggcatgatggttcttaaaatagtaagaaacatggaaaagtatcaattagcagtgactatcatggctatcttgtgcgtcccaaacgcagtgatattacaaaatgcatggaaagtgagttgcacaatactggcagtggtgtctgtttccccactgcttttgacatcctcacagcaaaaaacggattggataccattagcattgacaatcaagggtctcaatccaacagccattttcctaacaaccctctcaagaaccaacaagaaaaggagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaacaggcggagatatcaggaagcagtccaatcctgtcaataacaatatcagaagatggtagcatgtcgataaaaaatgaagaggaagaacaaacactgaccatactcattagaacaggattgctggtgatctcaggacttttccctatatcaataccaatcacggcagcagcatggtacctgtgggaagtgaagaaacaacgggccggagtattgtgggacgttccttcacccccacccatgggaaaagctgaactggaagatggagcttatagaatcaagcaaaaagggattcttggatattctcagatcggagctggagtttacaaagaaggaacattccatacaatgtggcatgtcacacgtggcgctgttctgatgcataaaggaaagaggattgaaccttcatgggcggacgtcaaaaaagatctaatatcatatggaggaggctggaagttagaaggagaatggaaggaaggagaagaagtccaagtgctggcactggagcctggaaaaaatccaagagccgtccaaacaaaacctggtcttttcaaaaccaataccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgagaaaagcactgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccattttacagacccagcaagtatagcagccagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgatcagtacatatacatgggagaacctctggaaaatgatgaagactgtgcacactggaaagaagccaaaatgctcctagataacattaacacaccagagggaatcattcccagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaaccatgctctcagtgaactgccggagaccctagagacactgcttttactgacacttttggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctggaaaaaacgaagaaagatcttggattaggaagcattgcaacccagcaacccgagagcaacatcctggacatagatttacgtcccgcatcagcttggacgctgtatgccgtggctacaacattcattacaccaatgctgagacatagcattgagaattcttcagtgaatacatccctaacagctatagccaaccaagcaacagtattaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggaccacatgggctctgtgtgaggccttaaccttagctacagggcccatctccacactgtgggaaggaaatccaggaaggttctggaacactaccattgcggtgtcaatggctaacatttttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaggtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaaaagaagtgaaaggcctaacaaaaggaggaccaggacacgaagaacccatacctatgtcaacatatgggtggaatctagtgcgtcttcagagtggagttgacgtcttcttcatcccgccagagaagtgtgacacattgttgtgtgacataggggagtcatcaccaaatcccacagtggaagcaggaagaacactcagagtccttaatttagtagaaaattggttgaacaacaacactcaattttgcataaaagttctcaacccatacatgccctcagttatagaaaaaatggaagcactgcaaaggaaatatggaggagccttagtgagaaacccactctcacggaactccacacatgagatgtactgggtatccaatgcttctgggaacatagtgtcatcagtgaacatgatttcaaggatgttgatcaacagattcacaatgagacacaagaaagccacttacgagccggatgttgacctcggaagcggaacccgtaatattggaattgaaagtgaagtaccaaacctagacataattgggaaaagaatagaaaaaataaagcaagagcatgaaacatcatggcactacgaccaagaccacccatacaaaacgtgggcataccatggtagctatgaaacaacacaaaccggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacaaagaaactaatgaaaatcacagcagagtggctgtggaaagaattagggaagaaaaagacacctaggatgtgcaccagagaagaatttacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacgtgtgtgtacaacatgatgggaaaaagagaaaagaagctgggggaattcggcaaggcaaaaggcagcagagccatatggtacatgtggcttggagctcgcttcctggagtttgaagccctaggattcctaaatgaggatcactggttctccagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatgaaaggagaacacaagaaattagccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaacatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagctcgaatctcccaaggagcagggtggtctttgcgggagacggcctgtttggggaagtcttacgcccaaatgtggagcttgatgtatttccacaggcgtgatctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagatttagaagagaagaggaagaagcaggagtcctgtggtaa

SEQ ID NO: 6517 - RNA, 9876 nt, synthetic construct
  misc_feature 1..9876: note = derived and/or modified CDS sequence (wt) from DENV-2__GU131928__SS-prME
  source 1..9876: mol_type = other RNA
tctgcaggcatgatcattatgctgattccaacagtaatggcgttccatctaaccacacgcaatggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcggcaatcctggcatacaccatagggacgacacatttccagagagtcctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtgacacctcactcaggggaagagcatgcggtcggaaatgacacaggaaaacacggcatggaaatcaaagtaacaccacagagctccatcacagaagcagaattgacaggttatggcaccgtcacgatggagtgctccccgagaacaggcctcgacttcaatgagatggtgttactgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactctatgtgcacaggaaagtttaaagttgtgaaggaaatagcagaaacacaacatggaacgatagttatcagagtgcaatatgaaggggacggctctccatgcaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatccataggaaaagctctccaccaagtctttggagcaatctatggagttgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcattacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaaccatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccctgagacagcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcacctaggcaagcttgagatggactttgatttctgcgatggaaccacagtgatagtgactgaggactgcggaaatagaggaccctctttgagaacaactactgcctctggaaaactcataacagaatggtgctgccgatcttgtacattaccacccctaagatacagaggtgaggatgggtgctggtacgggatggaaatcagaccattgaaagagaaagaagaaaatctggttaactccttggtcacagccggacatgggcaggttgacaatttttcactaggagtcttgggaatggcattattcctggaggaaatgcttaggacccgagtaggaacgaaacatgcaatactactagttgcagtttcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactacttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgcttactggacgatcggccgacttggaactggagagagcaaccgatgtcaaatgggaagaccaggcagagatatcgggaagcagtccaatcctgtcaataacaatatcagaagatggtagcatgtcgataaaaaacgaagaggaagaacaaacactgaccatactcattagaacaggattgctggtgatctcaggactttttcctatatcaataccaatcacagcagcagcgtggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcctccgggaagtagagatccatttccccagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgaggaaaaatggaaagaaagtaatacaacttagtagaaagacctttgattctgagtatgtcaagactagaaccaatgattgggatttcgtggttacaactgacatttcagagatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaacgtggaagttgaaatctggacaaaagaaggggaaaggaagaaattgaaacccagatggttggatgctaggatctactctgacccactggcgctaaaagaattcaaagaatttgcagccggaagaaagtctctgactctgaacctaatcacagaaatgggtaggcttccaacattcatgactcagaagacaagagatgcactggacaacctagcagtgctgcacacggctgaagcaggtggaagggcgtacaatcatgctctcagtgaactaccggagaccctagagacactgcttttactgacacttctggctacagtcacaggagggatctttttattcttgatgagtgggaggggcatagggaagatgaccctaggaatgtgctgcataatcacggctagcatccttctatggtacgcacaaatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcttagaaaaaacgaagaaagatcttggattaggaagcattgcaacccagcaacccgagagcaacatcctggacatagatctacgtcccgcatcagcttggacgctgtatgccgtggctacaacattcgtcacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctattattggtagcgcattatgccatcatagggccaggacttcaagcaaaagcaaccagagaagcccagaaaagagcagcggcaggcatcatgaaaaacccaaccgtcgatggaataacagtgattgatctagatccaataccttatgatccaaagtttgaaaagcagttaggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagaaacgcttggagagaaatggaaaagccgattgaacgcactgggaaaaagtgaattccaaatctacaagaaaagtggaatccaggaagtggatagaaccttagcaaaagaaggcatcaaaagaggagaaacggaccatcatgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaacgcttctgggaacatagtgtcatcagtgaacatgatttcaaggatgttgatcaatagattcacaatgagacacaagaaagctacttacgagccggatgttgacctcggaagcggaacccgtaacattggaattgaaagtgaaacaccaaacttagacataattgggaaaagaatagaaaaaataaaggaagagcatgaaacatcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatggggaaaagagaaaagaagctaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttatattctaagagacgtgagcaagaaagagggaggagccatgtacgccgacgacacagcaggatgggacacaagaatcacattagaagacctaaaaaatgaagaaatggtaacaaaccacatggaaggagaacataagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggaaggagaaggagtctttaaaaacatccagcacctgacagtcacagaagaagctgccgtgcaaaactggttggctagagtggggcgcgaaaggttgtcaagaatggccatcagtggagatgattgtgttgtgaaacctttagatgacaggttcgcaaacgctttgacagctctgaatgacatgggaaagattagaaaagacatacaacaatgggaaccttcaaaaggatggaacgattggacacaagtgcccttctgttcacaccatttccatgagctaatcatgaaggatggtcgtgtacttgttgttccatgtagaaatcaagatgaactgattggcagagcccgaatctcccaaggagcagggtggtctttgcgggagacggcctgtttggggaagtcttacgcccaaatgtggagcttaatgtatttccacaggcgtgacctcaggctggcggcaaatgccatttgctcggcagtgccatcacactgggttccaacaagtcgaacaacctggtccatacacgctaaacatgaatggatgacaacggaagacatgctgacagtctggaacagggtgtggattcgagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaggcaggagttctgtggtaa

SEQ ID NO: 6518 - RNA, 9876 nt, synthetic construct
  misc_feature 1..9876: note = derived and/or modified CDS sequence (wt) from DENV-2__GU131929__SS-prME
  source 1..9876: mol_type = other RNA
tctgcaggcatgatcattatgctgattccaacagtaatggcgttccatctaaccacacgcaatggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcggcaatcctggcatacaccatagggacgacacatttccagagagtcctgattttcatcctactgacagctgtcgctccttcaatgacaattcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtgacacctcactcaggggaagagcatgcggtcggaaatgacacaggaaaacacggcatggaaatcaaagtaacaccacagagctccatcacagaagcagaattgacaggttatggcaccgtcacgatggagtgctccccgagaacaggcctcgacttcaatgagatggtgttactgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactctatgtgcacaggaaagtttaaagttgtgaaggaaatagcagaaacacaacatggaacgatagttatcagagtgcaatatgaaggggacggctctccatgcaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatccataggaaaagctctccaccaagtctttggagcaatctatggagttgcctttagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcattacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaaccatcatgacaggagacatcaaaggaatcatgcaggcaggaaagcgatctttgcggcctcagcccactgagctaaagtattcatggaaaacatggggtaaagcaaaaatgctcttcacagagtcttataaccaaacctttctcattgatggccctgagacagcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcacctaggcaagcttgagatggactttgatttctgcgatggaaccacagtgatagtgactgaggactgcggaaatagaggaccctctttgagaacaactactgcctctggaaaactcataacagaatggtgctgccgatcttgtacattaccacccctaagatacagaggtgaggatgggtgctggtacgggatggaaatcagaccattgaaagagaaagaagaaaatctggttaactccttggtcacagccggacatgggcaggttgacaatttttcactaggagtcttgggaatggcattattcctggaggaaatgcttaggacccgagtaggaacgaaacatgcaatactactagttgcagtttcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactacttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgcttactggacgatcggccgacttggaactggagagagcaaccgatgtcaaatgggaagaccaggcagagatatcgggaagcagtccaatcctgtcaataacaatatcagaagatggtagcatgtcgataaaaaacgaagaggaagaacaaacactgaccatactcattagaacaggattgctggtgatctcaggactttttcctatatcaataccaatcacagcagcagcgtggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcctccgggaagtagagatccatttccccagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgaggaaaaatggaaagaaagtaatacaacttagtagaaagacctttgattctgagtatgtcaagactagaaccaatgattgggatttcgtggttacaactgacatttcagagatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaacgtggaagttgaaatctggacaaaagaaggggaaaggaagaaattgaaacccagatggttggatgctaggatctactctgacccactggcgctaaaagaattcaaagaatttgcagccggaagaaagtctctgactctgaacctaatcacagaaatgggtaggcttccaacattcatgactcagaagacaagagatgcactggacaacctagcagtgctgcacacggctgaagcaggtggaagggcgtacaatcatgctctcagtgaactaccggagaccctagagacactgcttttactgacacttctggctacagtcacaggagggatctttttattcttgatgagtgggaggggcatagggaagatgaccctaggaatgtgctgcataatcacggctagcatccttctatggtacgcacaaatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcttagaaaaaacgaagaaagatcttggattaggaagcattgcaacccagcaacccgagagcaacatcctggacatagatctacgtcccgcatcagcttggacgctgtatgccgtggctacaacattcgtcacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctattattggtagcgcattatgccatcatagggccaggacttcaagcaaaagcaaccagagaagcccagaaaagagcagcggcaggcatcatgaaaaacccaaccgtcgatggaataacagtgattgatctagatccaataccttatgatccaaagtttgaaaagcagttaggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagaaacgcttggagagaaatggaaaagccgattgaacgcactgggaaaaagtgaattccaaatctacaagaaaagtggaatccaggaagtggatagaaccttagcaaaagaaggcatcaaaagaggagaaacggaccatcatgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaacgcttctgggaacatagtgtcatcagtgaacatgatttcaaggatgttgatcaatagattcacaatgagacacaagaaagctacttacgagccggatgttgacctcggaagcggaacccgtaacattggaattgaaagtgaaacaccaaacttagacataattgggaaaagaatagaaaaaataaaggaagagcatgaaacatcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatggggaaaagagaaaagaagctaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttatattctaagagacgtgagcaagaaagagggaggagccatgtacgccgacgacacagcaggatgggacacaagaatcacattagaagacctaaaaaatgaagaaatggtaacaaaccacatggaaggagaacataagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggaaggagaaggagtctttaaaaacatccagcacctgacagtcacagaagaagctgccgtgcaaaactggttggctagagtggggcgcgaaaggttgtcaagaatggccatcagtggagatgattgtgttgtgaaacctttagatgacaggttcgcaaacgctttgacagctctgaatgacatgggaaagattagaaaagacatacaacaatgggaaccttcaaaaggatggaacgattggacacaagtgcccttctgttcacaccatttccatgagctaatcatgaaggatggtcgtgtacttgttgttccatgtagaaatcaagatgaactgattggcagagcccgaatctcccaaggagcagggtggtctttgcgggagacggcctgtttggggaagtcttacgcccaaatgtggagcttaatgtatttccacaggcgtgacctcaggctggcggcaaatgccatttgctcggcagtgccatcacactgggttccaacaagtcgaacaacctggtccatacacgctaaacatgaatggatgacaacggaagacatgctgacagtctggaacagggtgtggattcgagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaggcaggagttctgtggtaa

SEQ ID NO: 6519 - RNA, 9876 nt, synthetic construct
  misc_feature 1..9876: note = derived and/or modified CDS sequence (wt) from DENV-2__GU131930__SS-prME
  source 1..9876: mol_type = other RNA
tctgcaggcatgatcattatgctgattccaacagtgatggcgttccatctaaccacacgtaacggagaaccacacatgatcgtcggtatacaggagaaagggaaaagtcttctgttcaaaacagaggatggtgtgaacatgtgcaccctcatggctatggaccttggtgaattgtgtgaagacacaatcacatacaagtgtcctctgctcaggcagaatgagccagaggacatagactgttggtgcaactccacgtccacgtgggtaacctatgggacttgtactaccacgggagaacatagaagagaaaaaagatcagtggcactcgttccacatgtgggaatgggactggagacgcgaaccgaaacatggatgtcgtcagaaggggcttggaaacatgcccagagaattgaaacttggatcctgagacatccaggcttcaccataatggcagcaatcttggcatacaccatagggacgacacatttccagagagccctgattttcattctattgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaatacaacaacagaatcccgttgcccaacacaaggggaacccagcctaaaagaagagcaggataagaggttcgtctgcaaacactccatggtagacaggggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacagggaaacacggcaaggaaatcaaagtaacaccacagagttccatcacagaagctgaattgacaggttatggcaccgtcacgatggaatgctctccgagaacaggcctcgacttcaatgagatggtgttgctgcagatggaaagtaaagcttggctggtgcataggcaatggttcctagacctgccattaccgtggctgcccggagcggacaaacaagggtcaaattggatacagaaagaaacattggtcactttcaaaaatccccatgcaaagaaacaggatgttgttgttttaggatctcaagaaggggccatgcatacagcactcacaggagccacagagatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatacgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacaatgagaggagcaaagagaatggccattttgggtgacacagcctgggactttggctccctaggaggagtgtttacatctataggaaaagctctccaccaagtctttggagcaatctatggagctgccttcagtggggtttcatggactatgaaaatcctcataggagtcattattacatggataggaatgaactcacgcagcacttcactgtctgtgtcactagtattggtgggaattgtgactctgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccccgagacggcagaatgccctaacacaaatagagcttggaactcgttggaggttgaagactacggctttggagtgttcaccaccaatatatggctaaaattgaaagagaaacaggatgcattctgcgactcaaaactcatgtcagcagccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccacacacaaacagcaggaccatggcatctaggcaagcttgagatggactttgatttctgcgatggaaccacagtgatagtgaccgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaattccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcaccaccatgacggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccattcttgaattgactgatgcgttagccttaggcatgatggtcctcaaaatagtaagagacatggaaaagtatcaattagcagtgactattatggctatcttgtgcgtcccaaacgcagtgatattacagaatgcatggaaagtgagttgcacaatactggcagtggtgtccgtttccccactgcttttgacatcttcacagcaaaaaacggattggataccattagcattgacaattaagggcctcaatccaacagccatctttctaacaaccctctcaagaaccaacaagaaaaggagctggccactaaatgaggccatcatggcagtcggaatggtgagcattctagccagttccctcctgaaaaatgacattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcatcagaacaggattgctggtgatctcaggactttttcctgtatcaataccaatcacggcagcagcatggtacctgtgggaagtgaagaaacaacgggccggagtattgtgggacgttccctcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgttcaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccgataagataccaaaccccagctatcagagctgagcacactgggcgggaaattgtggatttaatgtgtcatgccacatttaccatgaggctgctatcaccagttagagtgccaaactacaacttgattatcatggacgaagcccatttcacagacccagcaagtatagcagctagaggatacatctcgacacgagtggagatgggtgaggcagctgggattttcatgacagccactcccccgggaagtagagatccatttcctcagagcaatgcaccaatcatagatgaagaaagagaaatccctgagcgttcatggaatactggacatgagtgggttacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgactgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaacccaaaaaatgaaaatgaccagtacatatacatgggagaacctctggaaaatgatgaagactgtgcacactggaaagaagccaaaatgctcctagacaacattaacacaccagaaggaatcattcccagtatgtttgaaccagagcgtgaaaaagtggatgccattgatggcgaataccgcttgagaggagaagcaaggaaaacctttgtggacttaatgaggagaggagacctaccagtctggttggcttacaaagtggcagctgaaggcatcaactatgcagacagaaggtggtgttttgatggaattaagaacaaccaaatcctggaagaaaatgtggaagttgaaatctggacaaaagaaggagaaaggaagaaattgaaacctagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgctcttactgacacttctggctacagtcacaggagggatctttttattcttgatgagcggaaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcctggacgctgtatgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaatccaactgtcgatggaataacagtgattgatctagatccaataccttatgatccaaagtttgaaaagcagttgggacaggtaatgctactaatcctctgcgtgactcaagtattgatgatgaggactacatgggctctgtgtgaggccttgaccttagctacagggcccatctccacactgtgggaaggaaatccaggaaggttctggaacactaccattgcggtgtcaatggctaacatctttagagggagttacttggctggagctggacttctcttttccattatgaagaacacaactaacacaagaaggggaactggcaacataggagagacgcttggagagaaatggaaaagccgattgaatgcactgggaaaaagtgaattccagacctacaagaaaagtggaatccaagaagtggatagaaccttagcaaaagaaggcatcaagagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaatgtaagagaagtgaaaggcctaacaaaaggaggaccaggacacgaagaacccatccctatgtcaacatatgggtggaatctagtgcgtctccagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcggtgaacatgatttcaaggatgttgatcaacagattcacaatgagacacaagaaagccacttacgagccggatgttgacctcggaagcggaacccgtaacattggaattgaaagtgaaataccaaacctagacataattgggaaaagaatagaaaaaataaaacaagagcacgaaacatcatggcactacgatcaagaccacccatacaaaacgtgggcataccatggtagctatgaaacaaaacagactggatcagcatcatccatggtcaacggagtggtcaggctactaacaaaaccttgggacgtccttcccacggtgacacagatggcaatgacagacacgactccatttggacaacagcgtgtttttaaagaaaaagtggacacgagaacccaagaaccgaaagaaggcacgaagaaattaatgaaaatcacagcagaatggctgtggaaagaattagggaagaaaaagacacctaggatgtgcaccagagaagaattcacaagaaaagtgagaagcaatgcagccttgggggccatattcactgacgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagaaggaggagccatgtacgccgacgacacagcaggatgggacacaagaatcacactagaagacttaaaaaatgaagaaatggtaacaaaccacatggaaggagaacacaaaaaattagccgaggctattttcaaactaacgtatcaaaacaaggtggtgcgtgtgcaaagaccaacaccaagaggcacagtaatggacatcatatcgagaagagaccaaagaggcagtgggcaagttggtacctatggactcaatactttcaccaatatggaagcccaattaatcagacagatggagggagaaggagtttttaaaaacatccagcacctgacagccacagaagaagttgccgtgaaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgcagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggctgcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggctaacaagcagggccacatgggcaaagaacatccaagcagcaataaatcaagttagatctcttataggcaatgaggaatacacagattacatgccatccatgaaaagattcagaagagaagaggaagaagcaggagtcctgtggtaa

SEQ ID NO: 6520 - RNA, 9876 nt, synthetic construct
  misc_feature 1..9876: note = derived and/or modified CDS sequence (wt) from DENV-2__GU131931__SS-prME
  source 1..9876: mol_type = other RNA
tctgcaggcatgatcattatgctgattccaacagtgatggcgttccatctaaccacacgcaatggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcggcaatcctggcacacaccatagggacgacacatttccagagagtcctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtgacacctcactcaggggaagagcatgcggtcggaaatgacacaggaaaacacggcatggaaatcaaagtaacaccacagagctccatcacagaagcagaattgacaggttatggcaccgtcacgatggagtgctccccgagaacaggcctcgacttcaatgagatggtgttactgcagatggaaaacaaagcttggctggtgcataggcaatggtttctagacctgccattaccatggctgcccggagcggataaacaagagtcaaactggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactctatgtgcacaggaaagtttaaagttgtgaaggaaatagcagaaacacaacatggaacgatagttatcagagtgcaatatgaaggggacggctctccatgcaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatccataggaaaagctctccaccaaatctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcattacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaaccatcatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccctgagacagcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgtacattaccacccctaagatacagaggtgaggatgggtgctggtacgggatggaaatcagaccattgaaagagaaagaagaaaatctggttaactccttggtcacagccggacatgggcaggttgacaatttttcattaggagtcttgggaatggcattattcctggaggaaatgcttaggacccgagtaggaacgaaacatgcaatactactagttgcagtttcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgtacaatactggcagtggtgtccgtttccccactacttttgacatcctcacagcaaaaaacggattggataccattagcattgacaatcaagggtctcaatccaacagccatttttttaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgcttactggacgatcggccgacttggaactggagagagcaaccgatgtcaaatgggaagaccaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctatatcaataccaatcacagcagcagcgtggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggcctttatggtaatggtgttgttacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgaacacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcctccgggaagtagagatccatttccccagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgaggaaaaatggaaagaaagtaatacaacttagtagaaagacctttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaacgtggaagttgaaatctggacaaaagaaggggaaaggaagaaattgaaacccagatggttggatgctaggatctactctgacccactggcgctaaaagaattcaaagaatttgcagccggaagaaagtctctgactctgaacctaatcacagaaatgggtaggcttccaacattcatgactcagaagacaagagatgcactggacaacctagcagtgctgcacacggctgaagcaggtggaagggcgtacaatcatgctctcagtgaactaccggagaccctagagacactgcttttactgacacttctggctacagtcacaggagggatctttttattcttgatgagtgggaggggcatagggaagatgaccctaggaatgtgctgcataatcacggctagcatccttctatggtacgcacaaatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcttagaaaaaacgaagaaagatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctattattggtagcgcattatgccatcatagggccaggacttcaagcaaaagcaaccagagaagcccagaaaagagcagcggcaggcatcatgaaaaacccaaccgtcgatggaataacagtgattgatctagatccaataccttatgatccaaagtttgaaaagcagttaggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagaaacgcttggagagaaatggaaaagccgattgaacgcactgggaaaaagtgaattccaaatctacaagaaaagtggaatccaggaagtggatagaaccttagcaaaagaaggcatcaaaagaggagaaacggaccatcatgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaacgcttctgggaacatagtgtcatcagtgaacatgatttcaaggatgttgatcaatagatttacaatgagacacaagaaagctacttacgagccggatgttgacctcggaagcggaacccgtaacattggaattgaaagtgaaataccaaacttagacataattgggaaaagaatagaaaaaataaaggaagagcatgaaacatcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttatattctaagagacgtgagcaagaaagagggaggagccatgtacgccgacgacacagcaggatgggacacaagaatcacactagaagacctaaaaaatgaagaaatggtaacgaaccacatggaaggagaacataagaaattggccgaggctattttcaaactaacgtatcaaaacaaggtggtgcgtgtgcagagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagctgccgtgcaaaactggttggctagagtggggcgcgaaaggttgtcaagaatggccatcagtggagatgattgtgttgtgaaacctttagatgacaggttcgcaaacgctttgacagctctgaatgacatgggaaagattagaaaagacatacaacaatgggaaccttcaaaaggatggaacgattggacacaagtgcccttctgttcacaccatttccatgagctaatcatgaaggatggtcgtgtacttgttgttccatgtagaaatcaagatgaactgattggcagagcccgaatctcccaaggagcagggtggtctttgcgggagacggcctgtttggggaagtcttacgcccaaatgtggagcttaatgtatttccacaggcgtgacctcaggctggcggcaaatgccatttgctcggcagtgccatcacactgggttccaacaagtcgaacaacctggtccatacacgctaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaggcaggagttctgtggtaa

SEQ ID NO: 6521 - RNA, 9876 nt, synthetic construct
  misc_feature 1..9876: note = derived and/or modified CDS sequence (wt) from DENV-2__GU131932__SS-prME
  source 1..9876: mol_type = other RNA
tctgcaggcatgatcattatgctgattccaacagtgatggcgttccatctaaccacacgcaatggagaaccacacatgatcgtcggtatacaggagaaagggaaaagtcttctgtttaaaacagaggatggtgtgaatatgtgcaccctcatggctatggaccttggtgaattgtgtgaggacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcagcaatcctggcatacaccatagggacgacacatttccagagagtcctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaatttggaatacaccattgtggtgacacctcactcaggggaagagcatgcggtcggaaatgacacaggaaaacacggcatggaaatcaaagtaacaccacagagctccatcacagaagcagaattgacaggttatggcaccgtcacgatggagtgctccccgagaacaggcctcgacttcaatgagatggtgttactgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactctatgtgcacaggaaagtttaaagttgtgaaggaaatagcagaaacacaacatggaacgatagttatcagagtgcaatatgaaggggacggctctccatgcaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaaactcaactggttcaagaaaggaagttctatcggccaaatgtttgagacaacgatgagaggggcgaagagaatggccattttgggtgacacagcctgggacttcggatccctgggaggagtgtttacatccataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcattacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaaccatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccctgagacagcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaacaactgcctctggaaaactcataacagaatggtgctgccgatcttgtacattaccacccctaagatacagaggtgaggatgggtgctggtacgggatggaaatcagaccattgaaagagaaagaagaaaatctggttaactccttggtcacagccggacatgggcaggttgacaatttttcactaggagtcttgggaatggcattattcctggaggaaatgcttaggacccgagtaggaacgaaacatgcaatactactagttgcagtttcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactacttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgcttactggacgatcggccgacttggaactggagagagcaaccgatgtcaaatgggaagaccaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctatatcaataccaatcacagcagcagcgtggtacctgtgggaagtgaagaaacaacgggccggagtattgtgggacgttccttcacccccacccatgggaaaggctgaactggaagatggagcctacagaatcaagcaaaaagggattcttggatactctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcctccgggaagtagagatccatttccccagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgaggaaaaatggaaagaaagtaatacaacttagtagaaagacctttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaacgtggaagttgaaatctggacaaaagaaggggaaaggaagaaattgaaacccagatggttggatgctaggatctactctgacccactggcgctaaaagaattcaaagaatttgcagccggaagaaagtctctgactctgaacctaatcacagaaatgggtaggcttccaacattcatgactcagaagacaagagatgcactggacaacctagcagtgctgcacacggctgaagcaggtggaagggcgtacaatcatgctctcagtgaactaccggagaccctagagacactgcttttactgacacttctggctacagtcacaggagggatctttttattcttgatgagtgggaggggcatagggaagatgaccctaggaatgtgctgcataatcacggctagcatccttctatggtacgcacaaatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcttagaaaaaacgaagaaagatcttggattaggaagcattgcaacccagcaacccgagagcaacatcctggacatagatctacgtcccgcatcagcttggactctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctattattggtagcgcattatgccatcatagggccaggacttcaagcaaaagcaaccagagaagcccagaaaagagcagcggcaggcatcatgaaaaacccaaccgtcgatggaataacagtgattgatctagatccaataccttatgatccaaagtttgaaaagcagttaggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagaaacgcttggagagaaatggaaaaaccgattgaacgcactgggaaaaagtgaattccaaatctacaagaagagtggaatccaggaagtggatagaaccttagcaaaagaaggcatcaaaagaggagaaacggaccatcatgctgtgtcgcgaggctcagcaaaactgagatggttcgttgagagaaacatggtcacaccagaagggaaagtagtggatctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaacgcttctgggaacatagtgtcatcagtgaacatgatttcaaggatgttgatcaatagattcacaatgagacacaagaaagctacttacgagccggatgttgacctcggaagcggaacccgtaacattggaattgaaagtgaaataccaaacttagacataattgggaaaagaatagaaaaaataaaggaagagcatgaaacatcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacaactccatttggacagcagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttatattctaagagacgtgagcaagaaagagggaggagccatgtacgccgacgacacagcaggatgggacacaagaatcacactagaagacctaaaaaatgaagaaatggtaacaaaccacatggaaggagaacataagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagctgccgtgcaaaactggttggctagagtggggcgcgaaaggttgtcaagaatggccatcagtggagatgattgtgttgtgaaacctttagatgacaggttcgcaaacgctttgacagctctgaatgacatgggaaagattagaaaagacatacaacaatgggaaccttcaaaaggatggaacgattggacacaagtgcccttctgttcacaccatttccatgagctaatcatgaaggatggtcgtgtacttgttgttccatgtagaaatcaagatgaactgattggcagagcccgaatctcccaaggagcagggtggtctttgcgggagacggcctgtttggggaagtcttacgcccaaatgtggagcttaatgtatttccacaggcgtgacctcaggctggcggcaaatgctatttgctcggcagtgccatcacactgggttccaacaagtcgaacaacctggtccatacacgctaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagttctgtggtaa

SEQ ID NO: 6522 - RNA, 9876 nt, synthetic construct
  misc_feature 1..9876: note = derived and/or modified CDS sequence (wt) from DENV-2__GQ199892__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctccttagacaaaatgaaccagaagacatagattgttggtgcaactctacgtccacatgggtaacttatgggacatgtaccaccacgggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgtcgctccttcaatgacaatgcgctgcataggaatatcaaatagagacttcgtggaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggatacacaaggatcaaattggatacagaaagagacattggtcactttcaaaaatccccacgccaagaaacaggatgtcgttgtcttagggtctcaagaaggggccatgcacacggcactcacaggggccacagaaatccagatgtcatcaggaaacttactgttcacgggacatctcaagtgcaggctgagaatggacaaactacagctcaaaggaatgtcatactccatgtgtacaggaaagtttaaaatcgtgaaggaaatagcagaaacacaacatggaacaatagttatcagagtacaatatgaaggggacggtgctccatgtaagatcccttttgagataacagatttggaaaaaagacacgtcttaggacgcctgattacagttaacccaatcgtaacagaaaaagatagcccagtcaacatagaagcagaacctccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagaacaatataagttccaaccagaatccccttcaaaactagcttcagccatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttctcattgatggccctgaaacagcagaatgccccaacacaaacagagcttggaactcactggaagttgaagactatggttttggagttttctccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccacacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggaatcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcattgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacgggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagatctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcgggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcattggacaacttggctgtgctgcatacggctgaggtaggtggaagggcgtacactcatgctctcagtgaactgccggagactctggagacactgcttctactgacactcctggcaacagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcttggacatagatctacgtcctgcatcagcatggacgctgtatgccgtggctacaacatttgtcacaccaatgctgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggagattttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactggggaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaatggagtggtcagactgctgacaaaaccttgggacgtcgtccccatggtgacacagatggcaatgacagatacgactccatttggacaacagcgcgttttcaaagagaaagtggacacgagaactcaagaaccgaaggaaggcacaaagaaactgatgaaaattacggcagagtggctttggaaagaactaggaaaggaaaagacacctagaatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatggggaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagagaagaggaagaggcaggtgtcctgtggtag

SEQ ID NO: 6523 - RNA, 9876 nt, synthetic construct
  misc_feature 1..9876: note = derived and/or modified CDS sequence (wt) from DENV-2__JF730044__SS-prME
  source 1..9876: mol_type = other RNA
acagcaggcgtgattattatgttgattccaacagcgatggcgttccatttaaccacacgcaatggagaaccacacatgatcgttggtagacaagagaaagggaaaagtcttctgttcaaaacagaggatggtgtgaacatgtgtaccctcatggccatagatcttggtgaactgtgtgaagatacaatcacgtacaagtgccccctcctcaggcagaatgaaccggaagacatagattgttggtgcaactccacgtccacatgggtaacttatgggacgtgtaccaccacaggagaacatagaagagaaaaaagatcagtggcactcgttccacatgtgggtatgggattggagacacgaactgaaacatggatgtcgtcagaaggggcctggaaacacgttcagagaattgaaacctggatcttgagacatccaggctttaccataatggcagcaatcctggcatacaccataggaacgacacatttccaaagggccctgattttcatcttactgacagctgttgctccttcaatgacaatgcgttgcataggaatatcaaatagagactttgtagaaggggtttcaggaggaagctgggttgacatagtcttagaacatggaagttgtgtgacgacaatggcaaaaaacaaaccaacattggattttgaactgataaaaacagaagccaaagaacctgccactctaaggaagtactgtatagaagcaaagctgaccaatacaacaacagaatctcgttgcccaacacaaggggaacccagtctaaatgaagagcaggacaaaaggttcgtctgcaaacactccatggtagacaggggatggggaaatggatgtggattatttggaaagggaggcattgtgacctgtgctatgtttacatgcaaaaagaacatggaaggaaaaatcgtgcaaccagaaaatttggaatacaccattgtgataacacctcactcaggagaagagcacgctgtaggtaatgacacaggaaaacatggtaaggaaatcaaaataacaccacagagttccagcacagaagcagaactgacaggctatggcacagtcacgatggagtgctctccgagaacgggccttgacttcaatgagatggtgctgctgcagatggaagacaaagcttggctggtgcacaggcaatggttcctagacctgccgttaccatggctacccggagcggacacacaaggatcaaattggatacagaaagagacactggtcactttcaaaaatccccacgcgaagaaacaggatgtcgttgtattaggatctcaagaaggggccatgcacacggcactcacgggggccacagaaatccagatgtcatcaggaaacttactattcacaggacatctcaagtgcaggctgaggatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgttttaggtcgcctgattacagttaacccgatcgtaacagaaaaagatagcccagtcaacatagaagcagaacctccatttggagacagctacatcatcataggagtagagccgggacaattgaaactcaactggtttaagaaaggaagttccatcggccaaatgtttgagacaacaatgagaggagcgaagagaatggccattttaggtgacacagcctgggattttggatccctgggaggagtgtttacatctatgggaaaggctctccaccaagttttcggagcaatctatggggctgcctttagtggggtctcatggactatgaaaatcctcataggagtcatcatcacatggataggaatgaattcacgtagcacctcactatccgtgtcactagtattggtgggagtcataacactgtacttgggagccatggtgcaggctgacagtggttgcgttgtgagctggaaaaacaaagaactgaaatgtggcagcgggatcttcattacagataacgtgcacacatggacagaacaatacaagttccaaccagaatccccttcaaaactagcttcagccatccaaaaagctcatgaagaaggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatctcacaatcagacctttctcattgatggccctgaaacagcagaatgccccaacacaaacagagcttggaactcgctggaagttgaagactatggttttggagttttcaccaccaatatatggctaaaattgagagaaaaacaggatgtgttttgtgactcaaaactcatgtcagcagccataaaagacaatagagccgtccatgccgatatgggttattggatagaaagtgcactcaatgacacatggaagatggagaaagcctctttcattgaagttaaaagctgccactggccaaagtcacacaccctctggagtaatggagtattagaaagtgagatgataattccaaaaagttttgctgggccagtgtcacaacacaactacagaccaggctattacacgcagacagcaggaccttggcatctaggtaagcttgagatggactttgatttctgcgaaggaactacagtggtggtgactgaagactgcggaaatagaggaccctctttaagaacaaccactgcctctggaaaactcataacagaatggtgctgccgatcctgcacattaccacctctaagatacagaggtgaggatggatgctggtatgggatggaaatcagaccattaaaagagaaagaagagaatttggtcaactccttggtcacagccggacatgggcagattgacaacttttcactaggagtcttaggaatggcactattcctggaagaaatgctcaggacacgagtaggaacgaaacatgcaatactgctagttgcagtttcttttgtgacattgattactgggaacatgtcttttagagacctgggaagggtgatggtcatggtgggcgctaccatgacggatgacataggcatgggagtgacttatctcgccctactagcagctttcaaagttagaccaacttttgcagctggactactactgagaaagctgacctccaaggaattgatgatggctaccataggaatcgcactcctttctcaaagcaccataccagagaccattcttgaactaactgatgcgttagccttgggcatgatggtccttaaaatagtgagaaatatggaaaaataccaattggcggtgactatcatggccatctcgtgtgtcccaaatgcagtgatactgcaaaatgcatggaaggtgagctgcacaatattggcagcggtgtccgtttctccactgctcttaacatcctcacagcagaaagcggattggataccgctggcattgacgataaaaggtctcaatccaacagccatttttctaacaactctttcgagaaccagcaagaaaaggagctggccgctaaatgaggctatcatggcagtcgggatggtgagtattttagccagttctctcttaaagaatgacattcccatgacaggtccattagtggctggagggctccttactgtgtgttacgtgctcactggacgatcggccgatttggaactggagagagccaccgatgtcaaatgggaagatcaggcagaaatatcagggagtagcccaatcctgtcaataacaatatcagaagatggcagcatgtcgataaaaaatgaagaggaagaacaaacactgaccatactcatcagaacgggattgctagtgatctcaggactctttccagtgtcaataccaattacagcagcagcatggtacctgtgggaagtgaagaaacaacgggctggagtattgtgggacgtcccttcacccccacccgtgggaaaggccgaactggaagatggagcctatagaatcaagcaaaaagggattcttggatattcccagattggagccggagtttacaaagaaggaacattccatacaatgtggcacgttacacgtggcgctgttctgatgcatagagggaagaggattgaaccatcatgggcggacgtcaagaaagacctaatatcatatggaggaggctggaagctcgaaggagaatggaaggaaggagaggaagtccaagtcctggcactggaacctggaaaaaatccaagagctgtccaaacgaaacctggacttttcaaaaccaacacaggaaccataggcgccgtatctctggacttttcccctggaacgtcaggatctccaattgtcgatagaaaaggaaaagttgtgggtctttatggcaatggtgttgtcacaaggagtggagcatacgtgagtgctatagcccagaccgagaaaagcattgaagacaatccagagatcgaagatgacattttccgaaagaaaagattgaccatcatggacctccatccaggagcgggaaagacaaaaagataccttccagccatagttagagaggccataaaacgtggcttgagaacattaatcctggcccccactagagtcgtggcagctgaaatggaggaagctcttagaggacttccaataagataccaaaccccagccatcagagccgagcacaccgggcgggagattgtggacctaatgtgtcatgccacatttactatgaggctgctatcaccagtcagagtgccaaattacaacctgatcatcatggatgaagctcacttcacagacccagcaagtatagcagctagaggatacatttcaactcgagtggagatgggtgaagcagctgggattttcatgacagccactcctccgggaagtagagacccatttcctcagagcaatgcaccaatcatggatgaggaaagagaaatccctgagcgttcgtggaactctggacatgaatgggtcacggattttaaagggaagactgtttggtttgttccaagtataaaagcgggaaatgacatagcagcctgcctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccccagacgctgcatgaaaccagttatactaacagatggcgaagagcgggtgatcttggcaggacccatgccagtgacccactctagtgcagcgcaaagaagagggagaatagggagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgcttgagaggagaagcaaggaaaacctttgtggatctaatgagaagaggggacttaccagtctggttggcctatagagtggcagctgaaggcatcaactacgcagacagaaggtggtgttttgatggagttaagaacaaccaaatactggaagaaaacgtggaagtggaaatttggacaaaagaaggggaaaggaagaaattaaaacccagatggctggatgctaggatctattctgacccactggcactaaaagaatttaaggaatttgcagctggaagaaagtccttgaccctgaacttaatcacagaaatgggtaggcttccaaccttcatgactcagaaggcaagagatgcactggataacctagctgtgctgcatacggctgaggcaggtggaagggcgtacaatcatgctctcagtgaactgccggagaccctggagacactgcttttactgacactcctggctacagtcacgggaggaatcttcttattcttaatgagcggaaaaggtgtagggaagatgaccctgggaatgtgctgcataatcacggccagcatcctcctatggtatgcacagatacaaccacactggatagcagcttcaataatattggagttttttctcatagttttgctcattccagaaccagaaaaacagagaacaccccaagataaccaactgacctatgttgtcatagccatccttacagtggtggccgcaaccatggcgaacgagatgggtttcctggaaaaaaccaagaaagaccttggattgggaagcattgcaacccaggaacctgagagcaacatcttggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttcccctccttgccattggatgctactcacaagtcaaccccgtaacgctcacagcagctcttcttttactggtagcacattatgccattatagggccaggacttcaagcgaaagcaaccagagaagctcagaaaagagcagcagcaggcatcatgaaaaacccaacagtcgatggaataacagtgattgacctagatccaataccctatgatccaaaatttgaaaaacagctaggacaagtaatgctcctaattctctgtgtgactcaagtattaatgatgaggactacatgggctctgtgtgaggctttaaccttagcgaccgggcccatctccacattgtgggagggcaatccagggaggttttggaacactaccattgcagtgtcaatggccaacatcttcagagggagctacttggctggagctggacttcttttttccatcatgaagaacacaacaaatacaagaagaggaactggcaacataggagagacgcttggagagaaatggaaaagccgattaaacgcactgggaaaaagtgaatttcagatctacaagaaaagtggaattcaggaagtggatagaaccttagctaaagaaggcatcaaaagaggagaaacggaccaccacgccgtgtcgcgaggctcagcaaaactgagatggttcgtcgaaagaaacatggtcacaccagaagggaaagtggtggacctcggttgcggcagagggggctggtcatactattgtgggggactaaagaatgtaaaagaagtcaaaggcctgacaaaaggaggaccaggacacgaagaacccatccccatgtcaacatatgggtggaatctagtacgtctgcagagtggagttgatgttttcttcactccgccagaaaagtgtgatacattgttgtgtgacataggggagtcgtcaccaaatcccacgatagaagcaggacgaacacttagagtcctcagcttggtggaaaattggctaaacaatgacacccaattttgcataaaggttctcaacccatatatgccctcagttatagaaaaaatggaaacactgcaaaggaaatatggaggagccctagtgaggaatccactctcacgaaactccacacatgagatgtactgggtatccaatgctactgggaacatagtgtcatcagtgaacatgatttcaaggatgctgattaacagattcacaatgaaacacaagaaagccacctacgagccagatgttgacctagggagcggaacccgcaacattggaattgaaagtgagataccaaatctagacataataggaaagagaatagagaaaataaagcaagaacatgaaacatcatggcactatgaccaagaccacccatacaaaacatgggcttaccatggcagctatgaaacaaaacagactggatcagcatcatccatggtgaacggagtggtcagactgctgacaaaaccttgggacgttgtccctatggtaacacagatggcaatgacagacacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagccttgggggccatattcactgatgagaacaaatggaagtcggcacgcgaggctgttgaagatagtaggttttgggagctggttgacaaggaaagaaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcctggagtttgaagccctgggattcttgaatgaagatcactggttctccagagagaactccctgagtggagtggaaggagaagggctgcacaagctaggctacattctaagagacgtgggcaagaaggaaggaggagcaatgtacgccgatgacacagcaggatgggacacaagaatcacactagaagacttaaaaaatgaagaaatggtgacaaaccacatggaaggagaacacaagaaactagccgaggccatatttaaattaacgtaccaaaacaaggtggtgcgtgtgcaaagaccaacaccaagaggtacagtaatggacatcatatcgagaagagatcaaagaggcagtgggcaagtcggcacctatggccttaacactttcaccaatatggaagcccaattaatcagacagatggagggagaaggaatttttaaaagcattcagcacctgacagccacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagtcagaaaagacatacaacaatgggaaccttcaagaggatggaatgattggacacaagtgcctttctgttcacaccactttcatgagttaatcatgaaagacggtcgcgtgctcgtagttccatgcagaaaccaagatgaactgattggcagggctcgaatttcccagggagctgggtggtctttgaaggagacggcctgcttggggaagtcttacgcccaaatgtggagcctgatgtacttccacagacgtgacctcaggctggcggcaaatgctatttgctcggcagtcccgtcacattgggttccaacaagccgaacaacctggtctatacacgccaaacatgaatggatgacgacggaagacatgctgacagtctggaacagggtgtggatccaagaaaatccatggatggaagacaaaactccagtggagtcatgggaggaagtcccatatctgggaaaaagagaagaccaatggtgcggctcattgattgggctaacaagcagggctacctgggcaaagaatatccaaacagcaataaatcaagtcagatcccttataggcaatgaggaatacacagattacatgccatccatgaagagattcagaagggaagaggaagaggcaggtgtcctgtggtag

SEQ ID NO: 6524 - RNA, 9876 nt, synthetic construct
  misc_feature 1..9876: note = derived and/or modified CDS sequence (wt) from DENV-2__FJ639697__SS-prME
  source 1..9876: mol_type = other RNA
acagcaggcgtgattattatgttgattccaacagcgatggcgttccatttaaccacacgcaatggagaaccacacatgatcgttggtagacaagagaaagggaaaagtcttctgttcaaaacagaggatggtgtgaacatgtgtaccctcatggccatagatcttggtgaactgtgtgaagatacaatcacgtacaagtgccccctcctcaggcagaatgaaccagaagacatagattgttggtgcaactccacgtccacatgggtaacttatgggacgtgtaccaccacaggagaacatagaagagaaaaaagatcagtggcactcgttccacatgtgggtatgggattggagacacgaactgaaacatggatgtcgtcagaaggggcctggaaacacgttcagagaattgaaacctggatcttgagacatccaggctttaccataatggcagcaatcctggcatacaccataggaacgacacatttccaaagggccctgattttcatcttactgacagctgttgctccttcaatgacaatgcgttgcataggaatatcaaatagagactttgtagaaggggtttcaggaggaagctgggttgacatagtcttagaacatggaagttgtgtgacgacaatggcaaaaaacaaaccaacattggattttgaactgataaaaacagaagccaaagaacctgccactctaaggaagtactgtatagaagcaaagctgaccaatacaacaacagaatctcgttgcccaacacaaggggaacccagtctaaatgaagagcaggacaaaaggttcgtctgcaaacactccatggtagacaggggatggggaaatggatgtggattatttggaaagggaggcattgtgacctgtgctatgtttacatgcaaaaagaacatggaaggaaaaatcgtgcaaccagaaaatttggaatacaccattgtgataacacctcactcaggagaagagcacgctgtaggtaatgacacaggaaaacatggtaaggaaatcaaaataacaccacagagttccagcacagaagcagaactgacaggctatggcacagtcacgatggagtgctctccgagaacgggccttgacttcaatgagatggtgctgctgcagatggaagacaaagcttggctggtgcacaggcaatggttcctagacctgccgttaccatggctacccggagcggacacacaaggatcaaattggatacagaaagagacactggtcactttcaaaaatccccacgcgaagaaacaggatgtcgttgttttaggatctcaagaaggggccatgcacacggcactcacgggggccacagaaatccagatgtcatcaggaaacttactattcacaggacatctcaagtgcaggctgaggatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgttttaggtcgcctgattacagttaacccgatcgtaacagaaaaagatagcccagtcaacatagaagcagaacctccatttggagacagctacatcatcataggagtagagccgggacaattgaaactcaactggtttaagaaaggaagttccatcggccaaatgtttgagacaacaatgagaggagcgaagagaatggccattttaggtgacacagcctgggattttggatccctgggaggagtgtttacatctatgggaaaggctctccaccaagttttcggagcaatctatggggctgcctttagtggggtctcatggactatgaaaatcctcataggagtcatcatcacatggataggaatgaattcacgtagcacctcactatccgtgtcactagtattggtgggagtcataacactgtacttgggagccatggtgcaggctgacagtggttgcgttgtgagctggaaaaacaaagaactgaaatgtggcagcgggatcttcattacagataacgtgcacacatggacagaacaatacaagttccaaccagaatccccttcaaaactagcttcagccatccaaaaagctcatgaagaaggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatctcacaatcagacctttctcattgatggccctgaaacagcagaatgccccaacacaaacagagcttggaactcgctggaagttgaagactatggttttggagttttcaccaccaatatatggctaaaattgagagaaaaacaggatgtgttttgtgactcaaaactcatgtcagcagccataaaagacaatagagccgtccatgccgatatgggttattggatagaaagtgcactcaatgacacatggaagatggagaaagcctctttcattgaagttaaaagctgccactggccaaagtcacacaccctctggagtaatggagtattagaaagtgagatgataattccaaaaagttttgctgggccagtgtcacaacacaactacagaccaggctattacacgcagacagcaggaccttggcatctaggtaagcttgagatggactttgatttctgcgaaggaactacagtggtggtgactgaagactgcggaaatagaggaccctctttaagaacaaccactgcctctggaaaactcataacagaatggtgctgccgatcctgcacattaccacctctaagatacagaggtgaggatggatgctggtatgggatggaaatcagaccattaaaagagaaagaagagaatttggtcaactccttggtcacagccggacatgggcagattgacaacttttcactaggagtcttaggaatggcactattcctggaagaaatgctcaggacacgagtaggaacgaaacatgcaatactgctagttgcagtttcttttgtgacattgattactgggaacatgtcttttagagacctgggaagggtgatggtcatggtgggcgctaccatgacggatgacataggcatgggagtgacttatctcgccctattagcagctttcaaagttagaccaacttttgcagctggactactactgagaaagctgacctccaaggaattgatgatggctaccataggaatcgcactcctttctcaaagcaccataccagagaccattcttgaactaactgatgcgttagccttgggcatgatggtccttaaaatagtgagaaatatggaaaaataccagttggcggtgactatcatggccatctcgtgtgtcccaaatgcagtgatactgcaaaatgcatggaaggtgagctgcacaatattggcagcggtgtccgtttctccactgctcttaacatcctcacagcagaaagcggattggataccgctggcattgacgataaaaggtctcaatccaacagccatttttctaacaactctttcgagaaccagcaagaaaaggagctggccgctaaatgaggctatcatggcagtcgggatggtgagtattttagccagttctctcttaaagaatgacattcccatgacaggtccattagtggctggagggctccttactgtgtgttacgtgctcactggacgatcggccgatttggaactggagagagccaccgatgtcaaatgggaagatcaggcagaaatatcagggagtagcccaatcctgtcaataacaatatcagaagatggcagcatgtcgataaaaaatgaagaggaagaacaaacactgaccatactcatcagaacgggattgctagtgatctcaggactctttccagtgtcaataccaattacagcagcagcatggtacctgtgggaagtgaagaaacaacgggctggagtattgtgggacgtcccttcacccccacccgtgggaaaggccgaactggaagatggagcctatagaatcaagcaaaaagggattcttggatattcccagattggagccggagtttacaaagaaggaacattccatacaatgtggcacgttacacgtggcgctgttctgatgcatagagggaagaggattgaaccatcatgggcggacgtcaagaaagacctaatatcatatggaggaggctggaagctcgaaggagaatggaaggaaggagaggaagtccaagtcctggcactggaacctggaaaaaatccaagagctgtccaaacgaaacctggacttttcaaaaccaacactggaaccataggcgccgtatctctggacttttcccctggaacgtcaggatctccaattgtcgatagaaaaggaaaagttgtgggtctttatggcaatggtgttgtcacaaggagtggagcatacgtgagtgctatagcccagaccgagaaaagcattgaagacaatccagagatcgaagatgacattttccgaaagaaaagattgaccatcatggacctccatccaggagcgggaaagacaaaaagataccttccagccatagttagagaggccataaaacgtggcttgagaacattaatcctggcccccactagagtcgtggcagctgaaatggaggaagctcttagaggacttccaataagataccaaaccccagccatcagagccgagcacaccgggcgggagattgtggacctaatgtgtcatgccacatttactatgaggctgctatcaccagtcagagtgccaaattacaacctgatcatcatggatgaagctcacttcacagacccagcaagtatagcagctagaggatacatttcaactcgagtggagatgggtgaagcagctgggattttcatgacagccactcctccgggaagtagagacccatttcctcagagcaatgcaccaatcatggatgaggaaagagaaatccctgagcgttcgtggaactctggacatgaatgggtcacggattttaaagggaagactgtttggtttgttccaagtataaaagcgggaaatgacatagcagcctgcctcaggaaaaatggaaagaaagtgatacaactcagtaggaagacctttgactctgagtatgttaagaccaggaccaatgattgggactttgtggtcacaaccgacatttcagaaatgggtgccaatttcaaggctgagagggttatagaccccagacgctgcatgaaaccagttatactaacagatggcgaagagcgggtgatcttggcaggacccatgccagtgacccactctagtgcagcgcaaagaagagggagaatagggagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgcttgagaggagaagcaaggaaaacctttgtggatctaatgagaagaggggacttaccagtctggttggcctatagagtggcagctgaaggcatcaactacgcagacagaaggtggtgttttgatggagttaagaacaaccaaatactggaagaaaacgtggaagtggaaatttggacaaaagaaggggaaaggaagaaattaaaacccagatggctggatgctaggatctattctgacccactggcactaaaagaatttaaggaatttgcagctggaagaaagtccttgaccctgaacttaatcacagaaatgggtaggcttccaaccttcatgactcagaaggcaagagatgcactggataacctagctgtgctgcacacggctgaggcaggtggaagggcgtacaatcatgctctcagtgaactgccggagaccctggagacactgctcttactgacactcctggctacagtcacgggaggaatcttcttattcttaatgagcggaaaaggtgtagggaagatgaccctgggaatgtgctgcataatcacggccagcatcctcctatggtatgcacagatacaaccacactggatagcagcttcaataatattggagttttttctcatagttttgctcattccagaaccagaaaaacagagaacaccccaagataaccaactgacctatgttgtcatagccatccttacagtggtggccgcaaccatggcgaacgagatgggtttcctggaaaaaaccaagaaagaccttggattgggaagcattgcaacccaggaacctgagagcaacatcttggacatagatctacgtcctgcgtcagcatggacgctgtatgccgtggccacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttcccctccttgccattggatgctactcacaagtcaaccccgtaacgctcacagcagctcttcttttactggtagcacattatgccattatagggccaggacttcaagcgaaagcaaccagagaagctcagaaaagagcagcagcaggcatcatgaaaaacccaacagtcgatggaataacagtgattgacctagatccaataccctatgatccaaaatttgaaaaacagctaggacaagtaatgctcctaattctctgtgtgactcaagtattaatgatgaggactacatgggctctgtgtgaggctttaaccttagcgaccgggcccatctccacattgtgggagggtaatccagggaggttttggaacactaccattgcagtgtcaatggccaacatcttcagagggagctacttggctggagctggacttcttttttccatcatgaagaacacaacaaatacaagaagaggaactggcaacataggagagacgcttggagagaaatggaaaagtcgattaaacgcactgggaaaaagtgaatttcagatctacaagaaaagtggaattcaggaagtggatagaaccctagctaaagaaggcatcaaaagaggagaaacggaccaccacgccgtgtcgcgaggctcagcaaaactgagatggttcgtcgaaagaaacatggtcacaccagaagggaaagtggtggacctcggttgcggcagagggggctggtcatactattgtgggggactaaagaatgtaaaagaagtcaaaggcctgacaaaaggaggaccaggacacgaagaacccatccccatgtcaacatatgggtggaatctagtacgtctgcagagtggagttgatgttttcttcactccgccagaaaagtgtgatacattgttgtgtgacataggggagtcgtcaccaaatcccacgatagaagcaggacgaacacttagagtcctcagcttggtggaaaattggctaaataatgacacccaattttgcataaaggttctcaacccatatatgccctcagttatagaaaaaatggaaacactgcaaaggaaatatggaggagccctagtgaggaatccactctcacgaaactccacacatgagatgtactgggtatccaatgctactgggaacatagtgtcatcagtgaacatgatttcaaggatgctgattaacagattcacaatgaaacacaagaaagccacctacgagctagatgttgacctagggagcggaacccgcaacattggaattgaaagtgagataccaaatctagacataataggaaagagaatagagaaaataaagcaagagcatgaaacatcatggcactatgaccaagaccacccatacaaaacatgggcttaccatggcagctatgaaacaaaacagactggatcagcatcatccatggtgaacggagtggtcagactgctgacaaaaccttgggacgttgtccctatggtaacacagatggcaatgacagacacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaatttacaagaaaagtgagaagcaatgcagccttgggggccatattcactgatgagaacaaatggaagtcggcacgcgaggctgttgaagatagtaggttttgggagctggttgacaaggaaagaaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcctggagtttgaagccctgggattcttgaatgaagatcactggttctccagagagaactccctgagtggagtggaaggagaagggctgcacaagctaggctacattctaagagacgtgggcaagaaggaaggaggagcaatgtacgccgatgacacagcaggatgggacacaagaatcacactagaagacttaaaaaatgaagaaatggtgacaaaccacatggaaggagaacacaagaaactagccgaggccatatttaaattaacgtaccaaaacaaggtggtgcgtgtgcaaagaccaacaccaagaggtacagtaatggacatcatatcgagaagagatcaaagaggcagtgggcaagtcggcacctatggccttaacactttcaccaatatggaagcccaattaatcagacagatggagggagaaggaatttttaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagtcagaaaagacatacaacaatgggaaccttcaagaggatggaatgattggacacaagtgcctttctgttcacaccactttcatgagttaatcatgaaagacggtcgcgtgctcgtagttccatgcagaaaccaagatgaactgattggcagggctcgaatttcccagggagctgggtggtctttgaaggagacggcctgcttggggaagtcttacgcccaaatgtggagcctgatgtacttccacagacgtgacctcaggctggcggcaaatgctatttgctcggcagtcccgtcacattgggttccaacaagccgaacaacctggtctatacacgccaaacatgaatggatgacgacggaagacatgctgacagtctggaacagggtgtggatccaagaaaacccatggatggaagacaaaactccagtggaatcatgggaggaagtcccatatctgggaaaaagagaagaccaatggtgcggctcattgattgggctaacaagcaggactacctgggcaaagaatattcaaacagcaataaatcaggtcagatcccttataggcaatgaggaatacacagattacatgccatccatgaagagattcagaagggaagaggaagaggcaggtgtcctgtggtag

SEQ ID NO: 6525 - RNA, 9876 nt, synthetic construct
  misc_feature 1..9876: note = derived and/or modified CDS sequence (wt) from DENV-2__FJ639698__SS-prME
  source 1..9876: mol_type = other RNA
acagcaggcgtgattattatgttgattccaacagcgatggcgttccacttaaccacacgtaatggagaaccacacatgatcgttggtagacaagagaaagggaaaagtcttctgttcaaaacagaggatggtgtgaacatgtgtaccctcatggccatagatcttggtgaattgtgtgaagacacaatcacgtacaagtgccccctcctcaggcagaatgaaccagaagacatagattgttggtgcaactccacgtctacatgggtaacttatgggacgtgtaccaccacaggagaacacagaagagaaaaaagatcagtggcactcgtcccacatgtgggtatgggattggagacacgaactgaaacatggatgtcgtcagaaggggcctggaaacacgctcagagaattgaaacctggatcttgagacatccaggctttaccataatggcagcaatcctagcatacaccataggaacgacacatttccaaagggccctgattttcatcttactgacagctgtcgctccttcaatgacaatgcgttgtataggaatatcaaatagagactttgtagaaggggtttcaggaggaagctgggttgacatagtcttagaacatggaagttgtgtgacgacaatggcaaaaaacaaaccaacattggattttgaattgataaaaacagaagccaaagaacctgccactctaagaaagtactgtatagaagcaaagctgaccaatacaacaacagaatctcgttgcccaacacaaggggaacccagtctaaatgaagagcaggacaaaaggttcgtttgcaaacactccatggtagacaggggatggggaaatggatgtggattatttggaaaaggaggcattgtgacctgtgctatgttttcatgcaaaaagaacatggaaggaaaaatcgtgcaaccagaaaatttggaatacaccatcgtgataacacctcactcaggagaagagcacgctgtaggtaatgacacaggaaaacatggtaaggaaatcaaaataacaccacagagttccatcacagaagcagaactgacaggctatggcacagtcacgatggagtgctctccgagaacgggccttgacttcaatgagatggtgctgctgcagatggaagacaaagcttggctggtgcacaggcaatggttcctagacctgccattaccatggctacccggagcggacacacaaggatcaaattggatacagaaagagacattggtcactttcaaaaatccccacgcgaaaaaacaggatgtcgttgtcttaggatctcaagaaggggccatgcacacggcactcacaggggccacagaaatccagatgtcatcaggaaacttactattcacaggacatctcaagtgcaggctgagaatggacaaactacagctcaaaggaatgtcatactctatgtgtacaggaaagtttaaaattgtgaaggaaatagctgaaacacaacatggaacaatagttatcagagtacaatatgaaggagacggctctccatgtaagatcccttttgaaataatggatttggaaaaaagacatgtcttaggtcgcctgattacagttaacccgatcataacagaaaaggatagcccagtcaacatagaagcagaacctccatttggagacagctacatcatcataggagtagagccgggacaattgaaactcaactggtttaagaaaggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcctttagtggggtctcatggactatgaaaatcctcataggagtcatcatcacatggataggaatgaattcacgcagcacctcactgtctgtgtcactagtattggtgggagtcataacactgtacttgggagccatggtgcaggctgatagtggttgcgttgtgagctggaaaaacaaagaactgaaatgtggcagcgggatcttcattacagacaacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatctcacaaccagacctttctcattgatggccctgaaacagcagaatgccccaacacaaacagagcttggaactcactggaagttgaagactatggttttggagttttcaccaccaatatatggctaaaattgaaagaaaaacaggatgtgttttgtgacccgaaactcatgtcggcagccataaaagacaatagagccgtccatgccgatatgggttattggatagaaagtgcactcaatgacacatggaagatggagaaggcctctttcattgaagttaaaagctgtcactggccaaagtcacacaccctctggagtaatggagtattagaaagtgagatgataattccaaaaggttttgctgggccagtgtcacaacacaactacagaccaggctactacacgcaaacagcaggaccttggcatctaggtaagcttgagatggactttgatttctgcgaaggaactacagtggtggtgactgaagactgcggaaatagaggaccctctttaagaacgaccactgcctctggaaaactcataacagaatggtgctgtcgatcctgcacattaccacctctaagatacagaggtgaggatggatgctggtatgggatggaaatcagaccattaaaagagaaagaggagaatttggtcaactccttggtcacagccggacatgggcagattgacaacttttcactaggagtcttgggaatggcattattcctggaagaaatgctcaggacacgagtaggaacgaaacatgcaatactgctagttgcagtttcttttgtgacattgattactgggaacatgtcctttagagacctgggaagagtgatggttatggtgggcgctaccatgacggatgacataggtatgggagtgacttatctcgccctactagcagctttcaaagttagaccaactttttcagctggacttctactgagaaagctgacctccaaggaattaatgatggctaccataggaattgcactcctttctcaaagcaccataccagagaccattcttgaactaactgatgcgttagccttgggcatgatggtccttaaaatagtgagaaacatggaaaagtaccaattggcagtgactatcatggccatctcgtgtgtcccaaatgcagtgatactgcaaaacgcatggaaggtgagctgcacaatactggcagcggtgtccgtttctccactgctcttaacatcctcacagcagaaagcggattggataccactggcactgacgataaaaggtctcaatccaacagccatttttctaacaactctttcgagaaccagcaagaaaaggagctggccgctaaatgaggctatcatggcagtcgggatggtgagcattttagccagctctctcttaaagaatgacattcccatgacaggtccattagtggctggagggcttcttactgtgtgttatgtgctcactggacgatcggccgatttggaactggagagagccaccgatgtcaaatgggaagatcaggcagaaatatcaggaagcagcccaatcctgtcaataacaatatcagaagatggcagcatgtcgataaaaaatgaagaggaagaacaaacactgaccatactcatcagaacgggattgctagtgatctcaggactctttccagtgtcaataccaattacagcagcagcatggtacctgtgggaagtgaagaaacaacgggctggagtattgtgggacgtcccttcacccccacccgtgggaaaggccgaactggaagatggagcctatagaatcaagcaaaaagggattcttggatattcccagattggagccggagtttacaaagaaggaacattccatacaatgtggcacgtcacacgtggtgctgttctgatgcatagagggaagaggattgaaccatcatgggcggacgtcaagaaagacctaatatcatatggaggaggctggaagctcgaaggagaatggaaggaaggagaggaagtccaagtcctggcactggaacctggaaaaaatccaagagctgtccaaacgaaacctggacttttcaaaaccaacaccggaaccataggcgccgtatctctggacttttcccctggaacgtcaggatctccaattgtcgacagaaaagggaaagttgtgggtctttatggcaatggcgttgtcacaaggagtggagcatacgtgagtgctatagctcagaccgagaaaagcattgaagacaatccagagatcgaagatgacatttttcgaaagaaaagattgaccatcatggacctccatccaggagcgggaaagacaaaaagataccttccagccatagttagagaggccataaaacgtggcttgagaacattaatcctggcccccactagagtcgtggcagctgaaatggaggaagctcttagaggacttccaataagataccaaaccccagccatcagagccgagcacactgggcgggagattgtggacctaatgtgtcatgccacatttactatgaggctgctatcaccagtcagagtgccaaattacaacctgatcatcatggatgaagctcacttcacagacccagcaagcatagcagctagaggatacatttcaactcgagtagagatgggtgaagcagctgggattttcatgacagccacccctccgggaagtagagacccatttcctcagagcaatgcaccaatcatggatgaggaaagagagatccctgagcgctcgtggaactccggacatgaatgggtcacggattttaaagggaagactgtttggtttgttccaagcataaaagcgggaaatgacatagcagcttgtctcagaaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccccagacgttgcatgaagccagttatactaacagatggcgaagagcgggtgatcttggcaggacccatgccagtaacccactctagtgcagcgcaaagaagagggagaataggaagaaatccaaaaaatgaaaatgatcagtacatatacatgggggaacctctggaaaatgatgaagactgtgcacattggaaagaagctaaaatgctcctagataacatcaatacacctgaaggaatcattcctagtatgtttgaaccagagcgtgaaaaggtagacgccattgatggtgaataccgcttgagaggagaagcaaggaaaacctttgtggacctaatgagaagaggggacttaccagtctggttggcctacagagtggcagctgaaggcatcaactacgcagacagaaggtggtgttttgatggagttaagaacaaccaaatactggaagaaaacgtggaagtggaaatttggacaaaagaaggggaaaggaagaaattaaaacccagatggttggatgctaggatctattctgacccactggcactaaaagaatttaaggaatttgcagctggaagaaagtccttgaccttgaacctaatcacagaaatgggtaggcttccgactttcatgactcagaaggcaagagacgcactggataacctagctgtgctgcatacggctgaggtaggtggaagggcgtacaatcatgctctcagtgaactgccggagaccctggagacactacttttactgacactcctggctacagtcacgggaggaattttcttattcttgatgagcggaaaaggtgtagggaagatgactctgggaatgtgctgcataatcacggccagcatcctcctatggtatgcacagatacaaccacactggatagcagcttcaataatattggagttttttctcatagttttgctcattccagaaccagaaaaacagagaacaccccaagataaccaattgacctacgttgtcatagccatcctcacagtggtggccgcaaccatggcaaacgagatgggtttcctggaaaaaaccaagaaagacctaggattgggaagcattgcaacccaagaacctgagagcaacatcctggacatagatctacgtcctgcgtcagcatggacgctgtatgccgtggctacaacatttgttacaccaatgttgagacatagcattgaaaattcctcagtgaatgtgtccctaacagccattgctaaccaagctacagtgttaatgggtcttgggaaaggatggccattgtcaaagatggacatcggggttcccctccttgccattggatgctactcacaagtcaaccccataactctcacagcagctcttcttttattggtagcacactatgccattatagggccaggacttcaagcgaaagcaaccagagaagctcagaaaagagcagcagcaggcatcatgaaaaacccaacagtcgatggaataacagtgattgacctagatccaataccctatgatccaaaatttgaaaaacagttaggacaagtaatgctcctaattctctgcgtgactcaagtattaatgatgaggactacatgggctctgtgtgaggctctaaccttggcgaccgggcccatctccacattgtgggaaggcaatccagggaggttttggaacaccacaattgcagtgtcaatggccaacatctttagagggagctacttggctggagctggacttcttttttccatcatgaagaacacaacaaatacaagaagaggaactggcaacataggagagacgcttggagagaaatggaaaagccgattaaacgcactgggaaaaaatgaatttcagatctacaaaaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgcggcagagggggctggtcatactattgtgggggactgaagaatgtaagagaagtcaaaggcctgacaaaaggaggaccaggacacgaagaacccatccccatgtcaacatatgggtggaatctagtacgtctgcagagtggagttgatgttttcttcactccgccagaaaagtgtgatacactgctgtgtgacataggggagtcgtcaccaaatcccacgatagaagcaggacgtacactcagagtcctcagcttggtggaaaattggttgaacaatgacacccaattttgcataaaggttctcaacccatatatgccctcagttatagaaaaaatggaaacactgcaaaggaaatatggaggagccttagtgaggaatccactctcacgaaactccacacatgagatgtactgggtatccaatgctactgggaacatagtgtcatcagtgaacatgatttcaaggatgctgattaacagattcacaatgaaacacaagaaagccacctacgagccagatgttgacctagggagcggaacccgcaacattggaattgaaagtgagataccaaatctagacataataggaaagagaatagagaaaataaagcaagagcatgaaacatcatggcactatgaccaagaccacccatacaaaacatgggcttaccatggcagctacgaaacaaaacagactggatcagcatcatccatggtgaacggagtggtcagactgctgacaaaaccttgggacgttgtccctatggtaacacagatggcaatgacagacacgactccatttgggcagcagcgcgttttcaaagagaaagtggacacgagaacccaggaaccgaaggaaggcacaaagaaactgatgaaaatcacggcaaagtggctttggaaagaactaggaaagaaaaagacacccagaatatgtaccagagaagaattcacaaaaaaagtgagaagcaatgcagccttgggggccatattcactgatgagaacaaatggaagtcggcacgcgaggctgttgaagatagtaggttttgggagctggttgacaaagaaagaaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcctggagtttgaagccctaggattcttgaatgaagatcactggttctccagagagaactccctgagtggagtggaaggagaagggctgcacaagctaggctacattctaagagacgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatatttaaattaacgtaccaaaacaaggtggtgcgtgtgcaaagaccaacaccaagaggcacagtaatggatatcatatcaagaagagaccaaagaggcagtgggcaagtcggcacctatggcctcaacactttcaccaatatggaagcccaattgattagacagatggagggagaaggaattttcaaaagcattcagcacctgacagtcacagaagaagtcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagacatacaacaatgggaaccttcacgaggatggaacgattggacacaagtgcctttctgttcacaccattttcatgagttaatcatgaaagacggtcgcgtgctcgtagttccatgcagaaaccaagatgaactgattggcagggcccgaatttcccagggagctgggtggtctttgaaggagacggcctgcttggggaagtcttacgcccaaatgtggagcctgatgtacttccacagacgtgacctcaggctggcggcaaatgctatttgctcggcagttccgtcacattgggttccaacaagtcgaacaacctggtctatacacgccaaacatgaatggatgacgacggaagacatgctgacagtctggaacagggtgtggatccaagaaaacccatggatggaagacaaaactccagtggagtcatgggaagaagtcccatacttgggaaaaagagaagaccaatggtgcggctcattgattgggctaacaagcagggctacctgggcaaagaacatccaaacagcaataaatcaagtcagatcccttataggcaatgaggagtacacagattacatgccatccatgaagagattcagaagggaagaggaagaggcaggtgtcctgtggtag

SEQ ID NO: 6526 - RNA, 9876 nt, synthetic construct
  misc_feature 1..9876: note = derived and/or modified CDS sequence (wt) from DENV-2__FJ639699__SS-prME
  source 1..9876: mol_type = other RNA
acagcaggcgtgattattatgttgattccaacagcgatggcgttccacttaaccacacgtaatggagaaccacacatgatcgttggtagacaagagaaagggaaaagtcttctgttcaaaacagaggatggtgtgaacatgtgtaccctcatggccatagatcttggtgaattgtgtgaagacacaatcacgtacaagtgccccctcctcaggcagaatgaaccagaagacatagattgttggtgcaactccacgtccacatgggtaacttatgggacgtgtaccaccacaggagaacacagaagagaaaaaagatcagtggcactcgtcccacatgtgggtatgggattggagacacgaactgaaacatggatgtcgtcagaaggggcctggaaacacgctcagagaattgaaacctggatcctgagacatccaggctttaccataatggcagcaatcctggcatacaccataggaacgacacatttccaaagggccctgattttcatcttactgacagctgtcgctccttcaatgacaatgcgttgtataggaatatcaaatagagactttgtagaaggggtttcaggaggaagctgggttgacatagtcttagaacatggaagttgtgtgacgacaatggcaaaaaacaaaccaacattggattttgaattgataaaaacagaagccaaagaacctgccactctaagaaagtactgtatagaagcaaagctgaccaatacaacaacagaatctcgttgcccaacacaaggggaacccagtctaaatgaagagcaggacaaaaggttcgtttgcaaacactccatggtagacaggggatggggaaatggatgtggattatttggaaaaggaggcattgtgacctgtgctatgttttcatgcaaaaagaacatggaaggaaaaatcgtgcaaccagaaaatttggaatacaccatcgtgataacaccccactcaggagaagagcacgctgtaggtaatgacacaggaaaacatggtaaggaaatcaaaataacaccacagagttccatcacagaagcagaactgacaggctatggcacagtcacgatggagtgctctccgagaacgggccttgacttcaatgagatggtgctgctgcagatggaagacaaagcttggctggtgcacaggcaatggttcctagacctgccattaccatggctacccggagcggacacacaaggatcaaattggatacagaaagagacattggtcacttttaaaaatccccacgcgaaaaaacaggatgtcgttgtcttaggatctcaagaaggggccatgcacacggcactcacaggggccacagaaatccagatgtcatcaggaaacttactattcacaggacatctcaagtgcaggctgagaatggacaaactacagctcaaaggaatgtcatactctatgtgtacaggaaagtttaaaattgtgaaggaaatagctgaaacacaacatggaacaatagttatcagagtacaatatgaaggagacggctctccatgtaagatcccttttgaaataatggatttggaaaaaagacatgtcttaggtcgcctgattacagttaacccgatcataacagaaaaggatagcccagtcaacatagaagcagaacctccattcggagacagctacatcatcataggagtagagccgggacaattgaaactcaactggtttaagaaaggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcctttagtggggtctcatggactatgaaaatcctcataggagtcatcatcacatggataggaatgaattcacgcagcacctcactgtctgtgtcactagtattggtgggagtcataacactgtacttgggagccatggtgcaggctgatagtggttgcgttgtgagctggaaaaacaaagaactgaaatgtggcagcgggatcttcattacagacaacgtgcacacatggacagaacaatacaagttccaaccagaatccccttcaaaactagcttcagctatccaaaaagctcatgaagagggtatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatctcacaaccagacctttctcattgatggccctgaaacagcagaatgccccaacacaaacagagcttggaactcactggaagttgaagactatggttttggagttttcaccaccaatatatggctaaaattgaaagaaaaacaggatgtgttttgtgactcgaaactcatgtcggcagccataaaagacaatagagccgtccatgccgatatgggttattggatagaaagtgcactcaatgacacatggaagatggagaaggcctctttcattgaagttaaaagctgtcactggccaaagtcacacaccctctggagtaatggagtattagaaagtgagatgataattccaaaaggttttgctgggccagtgtcacaacacaactacagaccaggctactacacgcaaacagcaggaccttggcatctaggtaagcttgagatggactttgatttctgcgaaggaactacagtggtggtgactgaagactgcggaaatagaggaccctctttaagaacgaccactgcctctggaaaactcataacagaatggtgctgtcgatcctgcacattaccacctctaagatacagaggtgaggatggatgctggtatgggatggaaatcagaccattaaaagagaaagaggagaatttggtcaactccttggtcacagccggacatgggcagattgacaacttttcactaggagtcttgggaatggcattattcctggaagaaatgctcaggacacgagtaggaacgaaacatgcaatactgctagttgcagtttcttttgtgacattgattactgggaacatgtcctttagagacctgggaagagtgatggttatggtgggcgctaccatgacggatgacataggtatgggagtgacttatctcgccctactggcagctttcaaagttagaccaacttttgcagctggacttctactgagaaagctgacttccaaggaattaatgatggctaccataggaattgcactcctttctcaaagcaccataccagagaccattcttgaactaactgatgcgttagccttgggcatgatgatccttaaaatagtgagaaacatggaaaagtaccaattggcagtgactatcatggccatctcgtgtgtcccaaacgcagtgatactgcaaaacgcatggaaggtgagctgcacaatactggcagcggtgtccgtttctccactgctcttaacatcctcacagcagaaagcggattggataccactggcactgacgataaaaggcctcaatccaacagccatttttctaacaactctttcgagaaccagcaagaaaaggagctggccgctaaatgaggctatcatggcagtcgggatggtgagcattttagccagctctctcttaaagaatgacattcccatgacaggtccattagtggctggagggctccttactgtgtgttatgtgctcactggacgatcggccgatttggaactggagagagccaccgatgtcaaatgggaagatcaggcagaaatatcaggaagcagcccaatcctgtcaataacaatatcagaagatggcagcatgtcgataaaaaatgaagaggaagaacaaacactgaccatactcatcagaacgggattgctagtgatctcaggactctttccagtgtcaataccaattacagcagcagcatggtacctgtgggaagtgaagaaacaacgggctggagtattatgggacgtcccttcacccccacccgtgggaaaggccgaactggaagatggagcctatagaatcaagcaaaaagggattcttggatattcccagattggagccggagtttacaaagaaggaacattccatacaatgtggcacgtcacacgtggtgctgttctgatgcatagagggaagaggattgaaccatcatgggcggacgtcaagaaagacctaatatcatatggaggaggctggaagctcgaaggagaatggaaggaaggagaggaagtccaagtcctggcactggaacctggaaaaaatccaagagctgtccaaacgaaacctggacttttcaaaaccaacaccggaaccataggcgccgtatctctggacttttcccctggaacgtcaggatctccaattgtcgacagaaaaggaaaagttgtgggtctttatggcaatggcgttgtcacaaggagtggagcatacgtgagtgctatagcccagaccgagaaaagcattgaagacaatccagagatcgaagatgacatttttcgaaagaaaagattgaccatcatggacctccatccaggagcgggaaagacaaaaagataccttccagccatagttagagaggccataaaacgtggcttgagaacattaatcctggcccccactagagtcgtggcagctgaaatggaggaagctcttagaggacttccaataagataccaaaccccagccatcagagccgagcacactgggcgggagatcgtggacctaatgtgtcatgccacatttactatgaggctgctatcaccagtcagagtgccaaattacaacctgatcatcatggatgaagctcacttcacagacccagcaagcatagcagctagaggatacatttcaactcgagtagagatgggtgaagcagctgggattttcatgacagccacccctccgggaagtagagacccatttcctcagagcaatgcaccaatcatggatgaggaaagagagatccctgagcgctcgtggaactctggacatgaatgggtcacggattttaaagggaagactgtttggtttgttccaagcataaaagcgggaaatgacatagcagcttgtctcagaaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccccagacgttgcatgaagccagttatactaacagatggcgaagagcgggtgatcttggcaggacccatgccagtaacccactctagtgcagcgcaaagaagagggagaataggaagaaatccaaaaaatgaaaatgatcagtatatatacatgggggaacctctggaaaatgatgaagactgtgcacattggaaagaagctaaaatgctcctagataacatcaatacacctgaaggaatcattcctagtatgtttgaaccagagcgtgaaaaggtagatgccattgatggtgaataccgcttgagaggagaagcaaggaaaacctttgtggacctaatgagaagaggggacttaccagtctggttggcctacagagtggcagctgaaggcatcaactacgcagacagaaggtggtgttttgatggggttaagaacaaccaaatactggaagaaaacgtggaagtggaaatttggacaaaagaaggggaaaggaagaaattaaaacccagatggttggatgctaggatctattctgacccactggcactaaaagaatttaaggaatttgcagctggaagaaagtccttgaccttgaacctaatcacagaaatgggtaggcttccgactttcatgactcagaaggcaagagacgcactggataacctagctgtgctgcatacggctgaggtaggtggaagggcgtacaatcatgctctcagtgaactgccggagaccctggagacactacttttactgacactcctggctacagtcacgggaggaattttcttattcttgatgagcggaaaaggtgtagggaagatgaccctgggaatgtgctgcataatcacggccagcatcctcctatggtatgcacagatacaaccacactggatagcagcttcaataatattggagttttttctcatagttttgctcattccagaaccagaaaaacagagaacaccccaagataaccaattgacctacgttgtcatagccatcctcacagtggtggccgcaaccatggcaaacgagatgggtttcctggaaaaaaccaagaaagacctaggattgggaagcattgcaacccaagaacctgagagcaacatcctggacatagatctacgtcctgcgtcagcatggacgctgtatgccgtggctacaacatttgttacaccaatgttgagacatagcattgaaaattcctcagtgaatgtgtccctaacagccattgctaaccaagctacagtgttaatgggtcttgggaaaggatggccattgtcaaagatggacatcggggttcccctccttgccattggatgctactcacaagtcaaccccataactctcacagcagctcttcttttattggtagcacactatgccattatagggccaggacttcaagcgaaagcaaccagagaagctcagaaaagagcagcagcaggtatcatgaaaaacccaacagtcgatggaataacggtgattgacctagatccaataccctatgatccaaaatttgaaaaacagttaggacaagtaatgctcctaattctctgcgtgactcaagtattaatgatgaggactacatgggctctgtgtgaggctctaaccttggcgaccgggcccatctccacattgtgggaaggcaatccagggaggttttggaacaccacaattgcagtgtcaatggccaacatctttagagggagctacttggctggagctggacttcttttttccatcatgaagaacacaacaaatacaagaagaggaactggcaacataggagagacgcttggagagaaatggaaaagccgattaaacgcactgggaaaaaatgaatttcagatctacaaaaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgcggcagagggggctggtcatactattgtgggggactgaagaatgtaagagaagtcaaaggcctgacaaaaggaggaccaggacacgaagaacccatccccatgtcaacatatgggtggaatctagtacgtctgcagagtggagttgatgttttcttcactccgccagaaaagtgtgatacactgctgtgtgacataggggagtcgtcaccaaatcccacgatagaagcaggacgtacactcagagtcctcagcttggtggaaaattggttgaacaatgacacccaattttgcataaaggttctcaacccatatatgccctcagttatagaaaaaatggaaacactgcaaaggaaatatggaggagccttagtgaggaatccactctcacgaaactccacacatgagatgtactgggtatccaatgctactgggaacatagtgtcatcagtgaacatgatttcaaggatgctgattaacagattcacaatgaaacacaagaaagccacctacgagccagatgttgacctagggagcggaacccgcaacattggaattgaaagtgagataccaaatctagacataataggaaagagaatagagaaaataaagcaagagcatgaaacatcatggcactatgaccaagaccacccatacaaaacatgggcttaccatggcagctacgaaacaaaacagactggatcagcatcatccatggtgaacggagtggtcagactgctgacaaaaccttgggacgttgtccctatggtaacacagatggcaatgacagacacgactccatttgggcagcagcgcgttttcaaagagaaagtggacacgagaacccaggaaccgaaggaaggcacaaagaaactgatgaaaatcacggcaaagtggctttggaaagaactaggaaagaaaaagacacccagaatatgtaccagagaagaattcacaaaaaaagtgagaagcaatgcagccttaggggccatattcactgatgagaacaaatggaagtcggcacgcgaggctgttgaagatagtaggttttgggagctggttgacaaagaaagaaatctccatcttgaaggaaagtgtgaaacatgtgtgtacaacatgatgggaaaaagagaaaagaaactaggggagttcggcaaggcaaaaggtagcagagccatatggtacatgtggcttggagcacgcttcctggagtttgaagccctaggattcttgaatgaagatcactggttctccagagagaactccctgagtggagtggaaggagaagggctgcacaagctaggctacattctaagagacgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatatttaaattaacgtaccaaaacaaggtggtgcgtgtgcaaagaccaacaccaagaggcacagtaatggatatcatatcaagaagagaccaaagaggcagtgggcaagtcggcacctatggcctcaacactttcaccaatatggaagcccaattgattagacagatggagggagaaggaattttcaaaagcattcagtacctgacagtcacagaagaagtcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagacatacaacaatgggaaccttcacgaggatggaacgattggacacaagtgcctttctgttcacaccattttcatgagttaatcatgaaagacggtcgcgtgctcgtagttccatgcagaaaccaagatgaactgattggcagggcccgaatttcccagggagctgggtggtctttgaaggagacggcctgcttggggaagtcttacgcccaaatgtggagcctgatgtacttccacagacgtgacctcaggctggcggcaaatgctatttgctcggcagttccgtcacattgggttccaacaagtcgaacaacctggtctatacacgccaaacatgaatggatgacgacggaagacatgctgacagtctggaacagggtatggatccaagaaaacccatggatggaagacaaaactccagtggagtcatgggaagaagtcccatacttgggaaaaagagaagaccaatggtgcggctcattgattgggctaacaagcagggctacctgggcaaagaacatccaaacagcaataaatcaagtcagatcccttataggcaatgaggagtacacagattacatgccatccatgaagagattcagaagggaagaggaagaggcaggtgtcctgtggtag

SEQ ID NO: 6527 - RNA, 9876 nt, synthetic construct
  misc_feature 1..9876: note = derived and/or modified CDS sequence (wt) from DENV-2__FJ639700__SS-prME
  source 1..9876: mol_type = other RNA
acagcaggcgtgattattatgttgattccaacagcgatggcgttccacttaaccacacgtaatggagaaccacacatgatcgttggtagacaagagaaagggaaaagtcttctgttcaaaacagaggatggtgtgaacatgtgtaccctcatggccatagatcttggtgaattgtgtgaagacacaatcacgtacaagtgccccctcctcaggcagaatgaaccagaagacatagattgttggtgcaactccacgtccacatgggtaacttatgggacgtgtaccaccacaggagaacacagaagagaaaaaagatcagtggcactcgtcccacatgtgggtatgggattggagacacgaactgaaacatggatgtcgtcagaaggggcctggaaacacgctcagagaattgaaacctggatcctgagacatccaggctttaccataatggcagcaatcctggcatacaccataggaacgacacatttccaaagggccctgattttcatcttactgacagctgtcgctccttcaatgacaatgcgttgtataggaatatcaaatagagactttgtagaaggggtttcaggaggaagctgggttgacatagtcttagaacatggaagttgtgtgacgacaatggcaaaaaacaaaccaacattggattttgaattgataaaaacagaagccaaagaacctgccactctaagaaagtactgtatagaagcaaagctgaccaatacaacaacagaatctcgttgcccaacacaaggggaacccagtctaaatgaagagcaggacaaaaggttcgtttgcaaacactccatggtagacaggggatggggaaatggatgtggattatttggaaaaggaggcattgtgacctgtgctatgttttcatgcaaaaagaacatggaaggaaaaatcgtgcaaccagaaaatttggaatacaccatcgtgataacaccccactcaggagaagagcacgctgtaggtaatgacacaggaaaacatggtaaggaaatcaaaataacaccacagagttccatcacagaagcagaactgacaggctatggcacagtcacgatggagtgctctccgagaacgggccttgacttcaatgagatggtgctgctgcagatggaagacaaagcttggctggtgcacaggcaatggttcctagacctgccattaccatggctacccggagcggacacacaaggatcaaattggatacagaaagagacattggtcacttttaaaaatccccacgcgaaaaaacaggacgtcgttgtcttaggatctcaagaaggggccatgcacacggcactcacaggggccacagaaatccagatgtcatcaggaaacttactattcacaggacatctcaagtgcaggctgagaatggacaaactacagctcaaaggaatgtcatactctatgtgtacaggaaagtttaaaattgtgaaggaaatagctgaaacacaacatggaacaatagttatcagagtacaatatgaaggagacggctctccatgtaagatcccttttgaaataatggatttggaaaaaagacatgtcttaggtcgcctgattacagttaacccgatcataacagaaaaggatagcccagtcaacatagaagcagaacctccatttggagacagctacatcatcataggagtagagccgggacaattgaaactcaactggtttaagaaaggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcctttagtggggtctcatggactatgaaaatcctcataggagtcatcatcacatggataggaatgaattcacgcagcacctcactgtctgtgtcactagtattggtgggagtcataacactgtacttgggagccatggtgcaggctgatagtggttgcgttgtgagctggaaaaacaaagaactgaaatgtggcagcgggatcttcattacagacaacgtgcacacatggacagaacaatacaagttccaaccagaatccccttcaaaactagcttcagctatccaaaaagctcatgaagagggtatttgtggaatccgctcagtaacaagattggagaatctgatgtggaaacaaataacaccagaattgaatcacattctatcagaaaatgaggcaaagttgaccattatgacaggagacattaaaggaatcatgcaggcaggaaaacgatctctgcggccccagcccactgagctgaagtattcatggaaaacatggggaaaggcgaaaatgctctccacagaatctcacaaccagacctttctcattgatggccctgaaacagcagaatgccccaacacaaacagagcttggaactcactggaagttgaagactatggttttggagttttcaccaccaatatatggctaaaattgaaagaaaaacaggatgtgttttgtgactcgaaactcatgtcggcagccataaaagacaatagagccgtccatgccgatatgggttattggatagaaagtgcactcaatgacacatggaagatggagaaggcctctttcattgaagttaaaagctgtcactggccaaagtcacacaccctctggagtaatggagtattagaaagtgagatgataattccaaaaggttttgctgggccagtgtcacaacacaactacagaccaggctaccacacgcaaacagcaggaccttggcatctaggtaagcttgagatggactttgatttctgcgaaggaactacagtggtggtgactgaagactgcggaaatagaggaccctctttaagaacgaccactgcctctggaaaactcataacagaatggtgctgtcgatcctgcacattaccacctctaagatacagaggtgaggatggatgctggtatgggatggaaatcagaccattaaaagagaaagaggagaatttggtcaactccttggtcacagccggacatgggcagattgacaacttttcactaggagtcttgggaatggcattattcctggaagaaatgctcaggacacgagtaggaacgaaacatgcaatactgctagttgcagtttcttttgtgacattgattactgggaacatgtcctttagagacctgggaagagtgatggttatggtgggcgctaccatgacggatgacataggtatgggagtgacttatctcgccctactggcagctttcaaagttagaccaacttttgcagctggacttctactgagaaagctgacttccaaggaattaatgatggctaccataggaattgcactcctttctcaaagcaccataccagagaccattcttgaactaactgatgcgttagccttgggcatgatgatccttaaaatagtgagaaacatggaaaagtaccaattggcagtgactatcatggccatctcgtgtgtcccaaacgcagtgatactgcaaaacgcatggaaggtgagctgcacaatactggcagcggtgtccgtttctccactgctcttaacatcctcacagcagaaagcggattggataccactggcactgacgataaaaggcctcaatccaacagccatttttctaacaactctttcgagaaccagcaagaaaaggagctggccgctaaatgaggctatcatggcagtcgggatggtgagcattttagccagctctctcttaaagaatgacattcccatgacaggtccattagtggctggagggctccttactgtgtgttatgtgctcactggacgatcggccgatttggaactggagagagccaccgatgtcaaatgggaagatcaggcagaaatatcaggaagcagcccaatcctgtcaataacaatatcagaagatggcagcatgtcgataaaaaatgaagaggaagaacaaacactgaccatactcatcagaacgggattgctagtgatctcaggactctttccagtgtcaataccaattacagcagcagcatggtacctgtgggaagtgaagaaacaacgggctggagtattatgggacgtcccttcacccccacccgtgggaaaggccgaactggaagatggagcctatagaatcaagcaaaaagggattcttggatattcccagattggagccggagtttacaaagaaggaacattccatacaatgtggcacgtcacacgtggtgctgttctgatgcatagagggaagaggattgaaccatcatgggcggacgtcaagaaagacctaatatcatatggaggaggctggaagctcgaaggagaatggaaggaaggagaggaagtccaagtcctggcactggaacctggaaaaaatccaagagctgtccaaacgaaacctggacttttcaaaaccaacaccggaaccataggcgccgtatctctggacttttcccctggaacgtcaggatctccaattgtcgacagaaaaggaaaagttgtgggtctttatggcaatggcgttgtcacaaggagtggagcatacgtgagtgctatagcccagaccgagaaaagcattgaagacaatccagagatcgaagatgacatttttcgaaagaaaagattgaccatcatggacctccatccaggagcgggaaagacaaaaagataccttccagccatagttagagaggccataaaacgtggcttgagaacattaatcctggcccccactagagtcgtggcagctgaaatggaggaagctcttagaggacttccaataagataccaaaccccagccatcagagccgagcacactgggcgggagattgtggacctaatgtgtcatgccacatttactatgaggctgctatcaccagtcagagtgccaaattacaacctgatcatcatggatgaagctcacttcacagacccagcaagcatagcagctagaggatacatttcaactcgagtagagatgggtgaagcagctgggattttcatgacagccacccctccgggaagtagagacccatttcctcagagcaatgcaccaatcatggatgaggaaagagagatccctgagcgctcgtggaactctggacatgaatgggtcacggattttaaagggaagactgtttggtttgttccaagcataaaagcgggaaatgacatagcagcttgtctcagaaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccccagacgttgcatgaagccagttatactaacagatggcgaagagcgggtgatcttggcaggacccatgccagtaacccactctagtgcagcgcaaagaagagggagaataggaagaaatccaaaaaatgaaaatgatcagtatatatacatgggggaacctctggaaaatgatgaagactgtgcacattggaaagaagctaaaatgctcctagataacatcaatacacctgaaggaatcattcctagtatgtttgaaccagagcgtgaaaaggtagatgccattgatggtgaataccgcttgagaggagaagcaaggaaaacctttgtggacctaatgagaagaggggacttaccagtctggttggcctacagagtggcagctgaaggcatcaactacgcagacagaaggtggtgttttgatggagttaagaacaaccaaatactggaagaaaacgtggaagtggaaatttggacaaaagaaggggaaaggaagaaattaaaacccagatggttggatgctaggatctattctgacccactggcactaaaagaatttaaggaatttgcagctggaagaaagtccttgaccttgaacctaatcacagaaatgggtaggcttccgactttcatgactcagaaggcaagagacgcactggataacctagctgtgctgcatacggctgaggtaggtggaagggcgtacaatcatgctctcagtgaactgccggagaccctggagacactacttttactgacactcctggctacagtcacgggaggaattttcttattcttgatgagcggaaaaggtgtagggaagatgaccctgggaatgtgctgcataatcacggccagcatcctcctatggtatgcacagatacaaccacactggatagcagcttcaataatattggagttttttctcatagttttgctcattccagaaccagaaaaacagagaacaccccaagataaccaattgacctacgttgtcatagccatcctcacagtggtggccgcaaccatggcaaacgagatgggtttcctggaaaaaaccaagaaagacctaggattgggaagcattgcaacccaagaacctgagagcaacatcctggacatagatctacgtcctgcgtcagcatggacgctgtatgccgtggctacaacatttgttacaccaatgttgagacatagcattgaaaattcctcagtgaatgtgtccctaacagccattgctaaccaagctacagtgttaatgggtcttgggaaaggatggccattgtcaaagatggacatcggggttcccctccttgccattggatgctactcacaagtcaaccccataactctcacagcagctcttcttttattggtagcacactatgccattatagggccaggacttcaagcgaaagcaaccagagaagctcagaaaagagcagcagcaggcatcatgaaaaacccaacagtcgatggaataacagtgattgacctagatccaataccctatgatccaaaatttgaaaaacagttaggacaagtaatgctcctaattctctgcgtgactcaagtattaatgatgaggactacatgggctctgtgtgaggctctaaccttggcgaccgggcccatctccacattgtgggaaggcaatccagggaggttttggaacaccacaattgcagtgtcaatggccaacatctttagagggagctacttggctggagctggacttcttttttccatcatgaagaacacaacaaatacaagaagaggaactggcaacataggagagacgcttggagagaaatggaaaagccgattaaacgcactgggaaaaaatgaatttcagatctacaaaaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgcggcagagggggctggtcatactattgtgggggactgaagaatgtaagagaagtcaaaggcctgacaaaaggaggaccaggacacgaagaacccatccccatgtcaacatatgggtggaatctagtacgtctgcagagtggagttgatgttttcttcactccgccagaaaagtgtgatacactgctgtgtgacataggggagtcgtcaccaaatcccacgatagaagcaggacgtacactcagagtcctcagcttggtggaaaattggttgaacaatgacacccaattttgcataaaggttctcaacccatatatgccctcagttatagaaaaaatggaaacactgcaaaggaaatatggaggagccttagtgaggaatccactctcacgaaactccacacatgagatgtactgggtatccaatgctactgggaacatagtgtcatcagtgaacatgatttcaaggatgctgattaacagattcacaatgaaacacaagaaagccacctacgagccagatgttgacctagggagcggaacccgcaacattggaattgaaagtgagataccaaatctagacataataggaaagagaatagagaaaataaagcaagagcatgaaacatcatggcactatgaccaagaccacccatacaaaacatgggcttaccatggcagctacgaaacaaaacagactggatcagcatcatccatggtgaacggagtggtcagactgctgacaaaaccttgggacgttgtccctatggtaacacagatggcaatgacagacacgactccatttgggcagcagcgcgttttcaaagagaaagtggacacgagaacccaggaaccgaaggaaggcacaaagaaactgatgaaaatcacggcaaagtggctttggaaagaactaggaaagaaaaagacacccagaatatgtaccagagaagaattcacaaaaaaagtgagaagcaatgcagccttaggggccatattcactgatgagaacaaatggaagtcggcacgcgaggctgttgaagatagtaggttttgggagctggttgacaaagaaagaaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcctggagtttgaagccctaggattcttgaatgaagatcactggttctccagagagaactccctgagtggagtggaaggagaagggctgcacaagctaggctacattctaagagacgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatatttaaattaacgtaccaaaacaaggtggtgcgtgtgcaaagaccaacaccaagaggcacagtaatggatatcatatcaagaaaagaccaaagaggcagtgggcaagtcggcacctatggcctcaacactttcaccaatatggaagcccaattgattagacagatggagggagaaggaattttcaaaagcattcagtacctgacagtcacagaagaagtcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagacatacaacaatgggaaccttcacgaggatggaacgattggacacaagtgcctttctgttcacaccattttcatgagttaatcatgaaagacggtcgcgtgctcgtagttccatgcagaaaccaagatgaactgattggcagggcccgaatttcccagggagctgggtggtctttgaaggagacggcctgcttggggaagtcttacgcccaaatgtggagcctgatgtacttccacagacgtgacctcaggctggcggcaaatgctatttgctcggcagttccgtcacattgggttccaacaagtcgaacaacctggtctatacacgccaaacatgaatggatgacgacggaagacatgctgacagtctggaacagggtgtggatccaagaaaacccatggatggaagacaaaactccagtggagtcatgggaagaagtcccatacttgggaaaaagagaagaccaatggtgcggctcattgattgggctaacaagcagggctacctgggcaaagaacatccaaacagcaataaatcaagtcagatcccttataggcaatgaggagtacacagattacatgccatccatgaagagattcagaagggaagaggaagaggcaggtgtcctgtggtag

SEQ ID NO: 6528 - RNA, 9876 nt, synthetic construct
  misc_feature 1..9876: note = derived and/or modified CDS sequence (wt) from DENV-2__GQ868620__SS-prME
  source 1..9876: mol_type = other RNA
tctgcaggcatgatcattatgctgattccaacagtgatggcgttccatctaaccacacgtaacggagaaccacacatgatcgtcggtatacaggagaaagggaaaagtcttctgttcaaaacagaggatggtgtaaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacttgtaccactacaggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacacttccagagagccctgattttcatcctactgacagctgtcgctccttcaatgacaatgcgctgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggtttgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggcaaggaaatcaaggtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggttgcccggagcggataaacaagggtcaaattggatacagaaagaaacattggtcactttcaaaaatccccatgctaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttattagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacccccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggctccctgggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtattggtgggaattgtgacactgtatctgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccacgccgacatgggttactggatagaaagtgcactaaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtgatagtgactgaggactgcggaaatagaggaccctctttgagaacaaccactgcctctggaaaactcataacagaatggtgctgccgatcttgcacattaccacccctaagatacagaggtgaggatgggtgctggtacgggatggaaatcagaccattgaaagagaaagaagaaaatctggttaactctttggtcacagccggacatgggcaggttgacaatttttcactgggagtcttgggaatggcattgttcctggaggaaatgcttaggacccgagtgggaacgaaacatgcaatactactagttgcagtttcttttgtgacattgatcacagggaacatgtccttcaaagacctaggaagagtggtggttatggtaggcgccaccatgacggatgacataggtatgggcgtgacctatcttgccctactagcagccttcaaagtcagaccaacttttgcagctggactactcttgagaaagctgacctccaaggaattgatgatgactaccataggaattgtactcctctcccaaagcactataccagagaccattcttgaattgactgatgcgttagccttaggcatgatggtccttaaaatagtaagaaacatggaaaagtatcaattagcagtgaccatcatggctatcttgtgcgtcccaaacgcagtgatattacaaaatgcatggaaagtgagttgcacaatactggcagtggtgtccgtttccccactgcttttgacatcctcacagcaaaaaactgattggataccattagcattgacaatcaagggtctcaatccaacagccatttttctgacaaccctctcaagaaccaacaagaaaaggagctggccactaaatgaggctatcatggcagttggaatggtgagcattttagccagctccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcatcagaacaggattgctggtgatctcaggactttttcctgtatcaataccaatcacggcagcagcatggtacctgtgggaggtaaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagtcgtccaaacaaaacctggtcttttcaaaaccaacaccggaacaataggtgccgtatctctggacttttcccctggaacgtcaggatctccaattattgacaaaaaaggaaaagttgtgggcctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacgaggtttgagaacattaatcttggcccccactagagttgtggcagctgaaatggaggaagctctcagaggacttccaataagataccaaaccccagccattagagctgagcacactgggcgggaaattgtggatctaatgtgtcatgctacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacagattttaaagggaagactgtttggttcgttccaagcataaaagcaggaaatgatatagcagcctgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcccagtatgtttgaaccagagcgtgaaaaagtggatgccattgatggcgaataccgcttgagaggagaagcaaggaaaacctttgtggacttaatgaggagaggagacctaccagtctggttggcttacaaagtggcggctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagaattcaaagaatttgcagccggaagaaagtctctgaccttgaacctaatcacagaaatgggtaggcttccaacattcatgactcagaagacaagagacgcactggacaacctagcagtgctgcacacggctgaagcaggtggaagggcgtacaatcatgctctcagtgaactaccggagaccctagagacactgctcttactgacacttctggctacagtcacaggagggatctttttatttttgatgagcgggaggggcatagggaagatgaccctgggaatgtgctgcataatcacggctagcatccttctatggtacgcacaaatacagccacattggatagcagcttcaataatactggagttttttctcatagttttgcttattccagaaccagaaaaacagaggacaccccaagacaaccaattgacctacgtcgtcatagccatcctcacagtggtggccgcaaccatggcaaacgagatgggtttcctagaaaaaacgaagaaagatcttggattgggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcctattgatagcgcattatgccatcatagggccaggacttcaagcaaaagcaaccagagaagcccagaaaagagcagcggcgggcatcatgaaaaatccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaatgcaaacaacacaagaagaggaactggcaacataggagagacgcttggagagaaatggaaaagccgattgaatgcactgggaaaaagtgaattccagatctacaagaaaagtggaatccaggaagtggatagaaccttagcaaaagaaggcatcaaaaggggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttatgtgacataggggagtcatcaccaaatcccacagtggaagcaggacgaacactcagagtccttaatttagtagaaaattggttgaacaacgacactcaattttgcataaaagtcctcaacccatatatgccctcagttatagaaaaaatggaagcactgcaaaggaaatatggaggagccttagtgagaaatccactctcacggaactccacacatgagatgtactgggtatccaatgcttctggaaacatagtgtcatcagtgaacatgatttcaaggatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggtactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagatacgactccatttggacaacagcgtgtttttaaagaaaaagtggacacgagaacccaagaacctaaagaaggcacgaagaaattaatgaaaatcacagcagagtggctgtggaaagaattagggaagaaaaagacacctaggatgtgcaccagagaagaattcataagaaaggtgagaagcaatgcagccttgggggccatattcactgatgagaacaagtggaagtcggcacgtgaggctgttgaagatagtaggttttgggaactggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttatattctaagagacgtgagcaagaaagagggaggagccatgtacgccgacgacacagcaggatgggacacaagaatcacactagaagacctaaaaaatgaagaaatggtaacaaaccacatggaaggagaacacaagaaattagccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttgaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcagcaaatgccatttgctcggcagtgccatcacactgggttccaacaagtcgaacaacctggtctatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaagttagatctcttataggcaatgaggaatacacagactacatgccatccatgaaaagattcagaagagaagaggaagaagcaggagtcctgtggtaa

SEQ ID NO: 6529 - RNA, 9876 nt, synthetic construct
  misc_feature 1..9876: note = derived and/or modified CDS sequence (wt) from DENV-2__FJ639702__SS-prME
  source 1..9876: mol_type = other RNA
acagcaggcgtgattattatgttgattccaacagcaatggcgttccatttaaccacacgcaatggagaaccacacatgatcgttggtagacaagagaaagggaaaagtcttctgttcaaaacagaggatggtgtgaacatgtgtaccctcatggccatagatcttggtgaactgtgtgaagatacaatcacgtacaagtgccccctcctcaggcagaatgaaccagaagacatagattgttggtgcaactccacgtccacatgggtaacttatgggacgtgtaccaccacaggagaacatagaagagaaaaaagatcagtggcactcgttccacatgtgggtatgggattggagacacgaactgaaacatggatgtcgtcagaaggggcctggaaacacgttcagagaattgaaacctggatcttgagacatccaggctttaccataatggcagcaatcctggcatacaccataggaacgacacatttccaaagggccctgattttcatcttactgacagctgttgctccttcaatgacaatgcgttgcataggaatatcaaatagagactttgtagaaggggtttcaggaggaagctgggttgacatagtcttagaacatggaagttgtgtgacgacaatggcaaaaaacaaaccaacattggattttgaactgataaaaacagaagccaaagaacctgccactctaaggaagtactgtatagaagcaaagctgaccaatacaacaacggaatctcgttgcccaacacaaggggaacccagtctaaatgaagagcaggacaaaaggttcgtctgcaaacactccatggtagacaggggatgggggaatggatgtggattatttggaaagggaggcattgtgacctgtgctatgtttacatgcaaaaagaacatggaaggaaaaatcgtgcaaccagaaaatttggaatacaccattgtgataacacctcactcaggagaagagcacgctgtaggtaatgacacaggaaaacatggtaaggaaatcaaaataacaccacagagttccagcacagaagcagaactgacaggctatggcacagtcacgatggagtgctctccgagaacgggccttgacttcaatgagatggtgctgctgcagatggaagacaaagcttggctggtgcacaggcaatggttcctagacctgccgttaccatggctacccggagcggacacacaaggatcaaattggatacagaaagagacactggtcactttcaaaaatccccacgcgaagaaacaggatgtcgttgtattaggatctcaagaaggggccatgcacacggcactcacgggggccacagaaatccagatgtcatcaggaaacttactattcacaggacatctcaagtgcaggctgaggatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgttttaggtcgcctgattacagttaacccgatagtaacagaaaaagatagcccagtcaacatagaagcagaacctccatttggagacagctacatcatcataggagtggagccgggacaattgaaactcaactggtttaagaaaggaagttccatcggccaaatgtttgagacaacaatgagaggagcgaagagaatggccattttaggtgacacagcctgggattttggatccctgggaggagtgtttacatctatgggaaaggctctccaccaagttttcggagcaatctatggggctgcctttagtggggtctcatggactatgaaaatcctcataggagtcatcatcacatggataggaatgaattcacgtagcacctcactatccgtgtcactagtattggtgggagtcataacactgtacttgggagccatggtgcaggctgacagtggttgcgttgtgagctggaaaaacaaagaactgaaatgtggcagcgggatcttcattacagataacgtgcacacatggacagaacagtacaagttccaaccagaatccccttcaaaactagcttcagccatccaaaaagctcatgaagaaggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatctcacaatcagacctttctcattgatggccctgaaacagcagaatgccccaacacaaacagagcttggaactcgctggaagttgaagactatggttttggagttttcaccaccaatatatggctaaaattgagagaaaaacaggatgtgttttgtgactcaaaactcatgtcagcagccataaaagacaatagagccgtccatgccgatatgggttattggatagaaagtgcactcaatgacacatggaagatggagaaagcctctttcattgaagttaaaagctgccactggccaaagtcacacaccctctggagtaatggagtattagaaagtgagatgataattccaaaaagttttgctgggccagtgtcacaacacaactacagaccaggctattacacgcagacagcaggaccttggcatctaggtaagcttgagatggactttgatttctgcgaaggaactacagtggtggtgacagaagactgcggaaatagaggaccctctttaagaacaaccactgcctctggaaaactcataacagaatggtgctgccgatcctgcacattaccacctctaagatacagaggtgaggatggatgctggtatgggatggaaatcagaccattaaaagagaaagaagagaatttggtcaactccttggtcacagccggacatgggcagattgacaacttttcactaggagtcttaggaatggcactattcctggaagaaatgctcaggacacgagtaggaacgaaacatgcaatactgctagttgcagtttctcttgtgacattgattactgggaacatgtcttttagagacctgggaagggtgatggtcatggtgggcgctaccatgacggatgacataggcatgggagtgacttatctcgccctactagcagctttcaaagttagaccaacttttgcagctggactacttctgagaaagctgacctccaaggaattgatgatggctaccataggaatcgcactcctttctcaaagcaccataccagagaccattcttgaactaactgatgcgttagccttgggcatgatggtccttaaaatagtgagaaatatggaaaaataccaattggcggtgactatcatggccatctcgtgtgtcccaaatgcagtgatactgcaaaatgcatggaaggtgagctgcacaatattggcagcggtgtccgtttctccactgctcttaacatcctcacagcagaaagcggattggataccgctggcattgacgataaaaggtctcaatccaacagccatttttctaacaactctttcgagaaccagcaagaaaaggagctggccgctaaatgaggctatcatggcagtcgggatggtgagtattttagccagttctctcttaaagaatgacattcccatgacaggtccattagtggctggagggctccttactgtgtgttacgtgctcactggacgatcggccgatttggaactggagagagccaccgatgtcaaatgggaagatcaggcagaaatatcagggagtagcccaatcctgtcaataacaatatcagaagatggcagcatgtcgataaaaaatgaagaggaagaacaaacactgaccatactcatcagaacgggattgctagtgatctcaggactctttccagtgtcaataccaattacagcagcagcatggtacctgtgggaagtgaagaaacaacgggctggagtattgtgggacgtcccttcacccccacccgtgggaaaggccgaactggaagatggagcctatagaatcaagcaaaaaggaattcttggatattcccagattggagccggagtttacaaagaaggaacattccatacaatgtggcacgttacacgtggcgctgttctgatgcatagagggaagaggattgaaccatcatgggcggacgtcaagaaagacctaatatcatatggaggaggctggaagctcgaaggagaatggaaggaaggagaggaagtccaagtcctggcactggaacctggaaaaaatccaagagctgtccaaacgaaacctggacttttcaaaaccaacacaggaaccataggcgccgtgtctctggacttttcccctggaacgtcaggatctccaattgtcgatagaaaaggaaaagttgtgggtctttatggcaatggtgttgtcacaaggagtggagcatacgtgagtgctatagcccagaccgagaaaagcattgaagacaatccagagatcgaagatgacattttccgaaagaaaagattgaccatcatggacctccatccaggagcgggaaagacaaaaagataccttccagccatagttagagaggccataaaacgtggcttgagaacattaatcctggcccccactagagtcgtggcagctgaaatggaggaagctcttagaggacttccaataagataccaaaccccagccatcagagccgagcacaccgggcgggagattgtggacctaatgtgtcatgccacatttactatgaggctgctatcaccagtcagagtgccaaattacaacctgatcatcatggatgaagctcacttcacagacccagcaagcatagcagctagaggatacatttcaactcgagtggagatgggtgaagcagctgggattttcatgacagccactcctccgggaagtaaagacccatttccccagagcaatgcaccaatcatggacgaggaaagagaaattcctgagcgttcgtggaactctggacatgaatgggtcacggattttaaagggaagactgtttggtttgttccaagtataaaagcgggaaatgacatagcagcctgcctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccccagacgctgcatgaaaccagttatactaacagatggcgaagagcgggtgatcttggcaggacccatgcctgtgacccactctagtgcagcgcaaagaagagggagaatagggagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagaacgtgaaaaggtggatgccattgatggtgaataccgcttgagaggagaagcaaggaaaacctttgtggatctaatgagaagaggggacttaccagtctggttggcctatagagtggcagctgaaggcatcaactacgcagacagaaggtggtgttttgatggagttaagaacaaccaaatactggaagaaaacgtggaagtggaaatttggacaaaagaaggggaaaggaagaaattaaaacccagatggctggatgctaggatctattctgacccactggcactaaaagaatttaaggaatttgcagctggaagaaagtccttgaccctgaacttaatcacagaaatgggtaggcttccaaccttcatgactcagaaggcaagagatgcactggataacctagctgtgctgcatacggctgaggcaggtggaagggcgtacaatcatgctctcagtgaactgccggagaccctggagacactgcttttactgacactcctggctacagtcacgggaggagtcttcttattcttaatgagtggaaaaggtgtagggaagatgaccctgggaatgtgctgcataatcacggccagcatcctcctatggtatgcacagatacaaccacactggatagcagcttcaataatattggagttttttctcatagttttgctcattccagaaccagaaaaacagagaacaccccaagataaccaactgacctatgttgtcatagccatccttacagtggtggccgcaaccatggcgaacgagatgggtttcctggaaaaaaccaagaaagaccttgggttgggaagcattgcaacccaggaacctgagagcaacatcttggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttcccctcctcgccattggatgctactcacaagtcaaccccgtaacgctcacagcagctcttcttttactggtagcacattatgccattatagggccaggacttcaagcgaaagcaaccagagaagctcagaaaagagcagcagcaggcatcatgaaaaacccaacagtcgatggaataacagtgattgacctagatccaataccctatgatccaaaatttgaaaaacagctaggacaagtaatgctcctaatcctctgtgtgactcaagtattaatgatgaggactacatgggctctgtgtgaggctttaaccttagcgaccgggcccatctccacattatgggagggcaatccagggaggttttggaacactaccattgcagtgtcaatggccaacatcttcagagggagctacttggctggagctggacttcttttttccatcatgaagaacacaacaaatacaagaagaggaactggcaacataggagagacacttggagagaaatggaaaagtcgattaaacgcactgggaaaaagtgaatttcagatctacaagaaaagtggaattcaggaagtggatagaaccttagctaaagaaggcatcaaaagaggagaaacggaccaccacgccgtgtcgcgaggctcagcaaaactgagatggttcgtcgaaagaaacatggtcacaccagaagggaaagtggtggacctcggttgcggtagagggggctggtcatactattgtgggggactaaagaatgtaaaagaagtcaaaggcctgacaaaaggaggaccaggacacgaagaacccatccccatgtcaacatatgggtggaatctagtacgtctgcagagtggagttgatgttttcttcactccgccagaaaagtgtgatacattgttgtgtgacataggggagtcgtcaccaaatcccacgatagaagcaggacgaacacttagagtcctcagcttggtggaaaattggctaaacaatgacacccaattctgcataaaggttctcaacccatatatgccctcagttatagaaaaaatggaaacactgcaaaggaaatatggaggagccctagtgaggaatccactctcacgaaactccacacatgagatgtactgggtatccaatgctactgggaacatagtgtcatcagtgaacatgatttcaaggatgctgattaacagattcacaatgaaacacaagaaagccacctacgagccagatgttgacctagggagcggaacccgcaacattggaattgaaagtgagataccaaatctagacataataggaaagagaatagagaaaataaagcaagagcatgaaacatcatggcactatgaccaagaccacccatacaaaacatgggcttaccatggcagctatgaaacaaaacagactggatcagcatcatccatggtgaacggagtggtcagactgctgacaaaaccttgggacgttgtccctatggtaacacagatggcaatgacagacacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagccttgggggccatattcactgatgagaacaaatggaagtcggcacgcgaggctgttgaagatagtaggttttgggagctggttgacaaggaaagaaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcctggagtttgaagccctgggattcttgaatgaagatcactggttctccagagagaactccctgagtggagtggaaggagaagggctgcacaagctaggctacattctaagagacgtgggcaagaaggaaggaggagcaatgtacgccgatgacacagcaggatgggacacaagaatcacactagaagacttaaaaaatgaagaaatggtgacaaaccacatggaaggagaacacaagaaactagccgaggccatatttaaattaacgtaccaaaacaaggtggtgcgtgtgcaaagaccaacaccaagaggtacagtaatggacatcatatcgagaagagatcaaagaggcagtgggcaagtcggcacctatggccttaacactttcaccaatatggaagcccaattaatcagacagatggagggagaaggaatttttaaaagcattcagcacctgacagccacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagtcagaaaagacatacaacaatgggaaccttcaagaggatggaatgattggacacaagtgcctttctgttcacaccactttcatgagttaatcatgaaagacggtcgcgtgctcgtagttccatgcagaaaccaagatgaactgattggcagggctcgaatttcccagggagctgggtggtctttgaaggagacggcctgcttggggaagtcttacgcccaaatgtggagcctgatgtacttccacagacgtgacctcaggctggcggcaaatgctatttgctcggcagtcccgtcacattgggttccaacaagccgaacaacctggtctatacacgccaaacatgaatggatgacgacggaagacatgctgacagtctggaacagggtgtggatccaagaaaatccatggatggaagacaaaactccagtggagtcatgggaggaagtcccatatctgggaaaaagagaagaccaatggtgcggctcattgattgggctaacaagcagggctacctgggcaaagaatatccaaacagcaataaatcaagtcagatcccttataggcaatgaggaatacacagattacatgccatccatgaagagattcagaagggaagaggaagaggcaggtgtcctgtggtag

SEQ ID NO: 6530 - RNA, 9876 nt, synthetic construct
  misc_feature 1..9876: note = derived and/or modified CDS sequence (wt) from DENV-2__GQ868621__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaactgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagttctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggacaagaggttcgtctgcaaacactccatggtagacagaggatggggaaatggatgtggattatttggaaaggggggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatatcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatctctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcgtcagctatccagaaggctcaagaagagggaatttgtgggatccgctcggtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaactgaaagaaaaacaggacgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactacagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttatgacattgatcacagggaacatgtccttcaaagacctaggaagagtggtggttatggtaggcgctaccatggcggatgacataggtatgggcgtgacttatcttgccctactagcagctttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacacacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcactgacccagcaagcatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactgacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacatcaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagaattcaaagaatttgcggccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattaacctacgttgtcatagccatcctcacagtggtggccgcaaccatggcaaacgagatgggtttcctagaaaaaacgaagaaggatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcttattggtagcgcattatgccattatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgagaactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgctgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccctagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgtaacattggaattgaaagtgaagtaccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctgggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggggatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagttaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacctgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6531 - RNA, 9876 nt, synthetic construct
  misc_feature 1..9876: note = derived and/or modified CDS sequence (wt) from DENV-2__FJ639704__SS-prME
  source 1..9876: mol_type = other RNA
tctgcaggcatgatcattatgctgattccaacagtggtggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagctacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctaggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcctactgagctaaagtattcatggaaaacatggggtaaaacaaaaatgctctccacagagtcttataaccaaacctttctcattgatggccccgagacgacagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaacctggttaactccttggtcacagccggacatgggcaggttgacaatttttcactgggagtcctgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgaccaccataggaattgtactcctctcccaaagcactataccagagaccattcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaagcggattggataccattagcattgacaatcaagggtctcaatccaacagccatttttctaacaaccctctcaagaaccaacaagaaaaggagctggccactaaatgaggctatcatggcagtcggaatggtgagcattttagccagttccctcctaaaaaatgatattcccatgacaggaccactagtagctggagggctcctcactgtgtgctacgtgctcactggacgatcggccgatttggaactggagagagcaaccgatgtcaaatgggaagaacaggcagagatatcaggaagcagtccaatcctgtcaataacaatatcagaagatggtagcatgtcgataaaaaatgaagaggaagaacaaacactgaccatactcattagaacaggattgctggtgatctcaggacttttccctatatcaataccaatcacggcagcagcatggtacctgtgggaagtgaagaaacaacgggctggagtattgtgggacgttccttcacccccacccatgggaaaagctgagctggaagatggagcctatagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaagaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccattttacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggagccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgatcagtacatatacatgggagaacctctggaaaatgatgaagactgtgcacactggaaagaagccaaaatgctcctagacaacattaacacaccagagggaatcattcccagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacactcctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctggaaaaaacgaagaaagatcttggattaggaagcattgcaacccagcaacccgagagcaacatcctggacatagatctacgtcccgcatcagcttggacgctgtatgccgtggctacaacattcattacaccaatgctgagacatagcattgagaattcttcagtgaatatatccctaacagctatagccaaccaagcaacagtattaatgggtctagggaaaggatggccattgtcaaagatggacatcggagttccccttctcgccattggatgttactcacaagtcaatcccataactctcacagcagctcttctcttattggtagcgcactatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatttttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaggtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaaaagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggaagaacactcagagtccttaatttagtagaaaactggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaacagattcacaatgagacacaagaaagccacttacgagccggatgttgacctcggaagcggaacccgtaacattggaattgaaagtgaagtaccaaacctagacataattgggaaaagaatagaaaaaataaagcaagagcatgaaacatcatggcactacgaccaagaccacccatacaaaacgtgggcataccatggtagctatgaaacaaaacaaactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacgtgtgtgtacaacatgatgggaaagagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattagccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagatttagaagagaagaggaagaagcaggagtcctgtggtaa

SEQ ID NO: 6532 - RNA, 9876 nt, synthetic construct
  misc_feature 1..9876: note = derived and/or modified CDS sequence (wt) from DENV-2__GQ868622__SS-prME
  source 1..9876: mol_type = other RNA
tctgcaggcatgatcattatgctgattccaacagtgatggcgttccatctaaccacacgtaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacttgtactactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcttggcatacaccatagggacgacacatttccagagagccctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagctagacagcctgccaccctaaggaagtattgcatagaagcaaagctaaccaatacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacaccccactcaggggaagagcatgcggtcggaaatgacacagggaaacatggcaaggaaatcaaagtaacaccacagagttccatcacagaagctgaattgacaggttatggcaccgtcacgatggagtgctctccgagaacaggcctcgacttcaatgagatggtgttgctgcagatggaaaataaagcttggctggtgcataggcaatggttcctagacctgccattaccgtggctgcccggagcggacaaacaagggtcaaattggatacagaaagaaacattggtcactttcaaaaatccccatgcaaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatacgaaggggacggctctccatgtaaaatcccttttgagataatggatttggaaaaaagatatgtcctaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcaaagagaatggccatcttgggtgacacagcctgggacttcggctccctaggaggagtgtttacatctataggaaaagctctccaccaagtctttggagcaatctatggagctgccttcagtggggtttcatggactatgaaaatcctcataggagtcattatcacatggataggaatgaactcacgcagcacttcactgtctgtgtcactagtattggtgggaattgtgacactgtacttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccccgagacggcagaatgccccaacacaaatagagcttggaactcgttggaggttgaagactacggcttcggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggcaagcttgagatggactttgatttctgcgatggaaccacagtgatagtgaccgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaattctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatctcgccctactagcagccttcaaagttagaccaacttttgcagctggactactcttgagaaagctgacctccaaggaattgatgatgactaccataggaattgtgctcctctcccaaagcactataccagagaccattcttgaattgactgatgcgttagccttaggcatgatggtcctcaaaatagtaagagacatggaaaagtatcaattagcagtgactattatggctatcttgtgcgtcccaaacgcagtgatattacagaatgcatggaaagtgagttgcacaatactggcagtggtgtccgtttccccactgcttttgacatcttcacagcaaaaaacggattggataccattagcattgacaattaagggtctcaatccaacagccatctttctaacaaccctctcaagaaccaacaagaaaaggagctggccactaaatgaggccatcatggcagtcggaatggtgagcattttagccagttccctcctgaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcatcagaacaggattgctggtgatctcaggactttttcctgtatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgcggttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgttcaaacaaaacctggtcttttcaaaaccaacaccggaacaataggtgccgtgtctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccaataagataccaaaccccagctatcagagctgagcacactgggcgggaaattgtggatttaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggttacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctttggaaaatgatgaagactgtgcacactggaaagaagccaaaatgctcctagacaacattaacacaccggaaggaatcattcccagtatgtttgaaccagagcgtgaaaaagtggatgccattgatggcgaataccgcttgagaggagaagcaaggaaaacctttgtggacttaatgaggaggggagacctaccagtctggttggcttacaaagtggcagctgaaggcatcaactatgcagacagaaggtggtgttttgatggaattaagaacaaccaaatcctggaagaaaatgtggaagttgaaatctggacaaaagaaggagaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgctcttactgacacttctggctacagtcacaggagggatctttttattcttgatgagcgggaggggcatagggaagatgaccctgggaatgtgctgcataatcacggctagcatccttctatggtacgcacagatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagtaacatcctggacatagatctacgtcccgcatcagcttggacgctgtatgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaatccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaatgcactgggaaaaagtgaattccagacctacaagaaaagtggaatccaggaagtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatacgggtggaatctagtgcgtctccagagcggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcggtgaatatgatttcaaggatgttgatcaacagattcacaatgagacacaagaaagccacttacgagccggatgttgacctcggaagcggaacccgcaacattggaattgaaagtgaaataccaaacctagacataattgggaaaagaatagaaaaaataaagcaagagcatgaaacatcatggcactacgatcaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaattaatgaaaatcacagcagaatggctgtggaaagaattagggaagaaaaagacacctaggatgtgcaccagagaagaattcacaagaaaggtgagaagcaatgcagccttgggggccatattcactgacgagaataagtggaagtcggcacgtgaggctgttgaagatagaaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtacgccgacgacacagcaggatgggacacaagaatcacactagaagacttaaaaaatgaagaaatggtaacaaaccacatggaaggagaacacaagaaattagccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagccacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggctaacaagcagggccacatgggcaaagaacatccaagcagcaataaatcaagttagatctcttataggcaatgaggaatacacagattacatgccatccatgaaaagattcagaagagaagaggaagaagcaggagtcctgtggtaa

SEQ ID NO: 6533 - RNA, 9876 nt, synthetic construct
  misc_feature 1..9876: note = derived and/or modified CDS sequence (wt) from DENV-2__FJ639705__SS-prME
  source 1..9876: mol_type = other RNA
tctgcaggcatgatcattatgctgattccaacagtgatggcgttccatctaaccacacgtaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacttgtactaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcttggcatacaccatagggacgacacatttccagagagccctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagctagacagcctgccaccctaaggaagtattgcatagaagcaaagctaaccaatacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacagggaaacatggcaaggaaatcaaagtaacaccacagagttccatcacagaagctgaattgacaggttatggcaccgtcacgatggagtgctctccgagaacaggcctcgacttcaatgagatggtgttgctgcagatggaaaataaagcttggctggtgcataggcaatggttcctagacctgccattaccgtggctgcccggagcggacaaacaagggtcaaattggatacagaaagaaacattggtcactttcaaaaatccccatgcaaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatacgaaggggacggctctccatgtaaaatcccttttgagataatggatttggaaaaaagatatgtcctaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcaaagagaatggccattttgggtgatacagcctgggacttcggctccctaggaggagtgtttacatctataggaaaagctctccaccaagtctttggagcaatctatggagctgccttcagtggggtttcatggactatgaaaatcctcataggagtcattatcacatggataggaatgaactcacgcagcacttcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccccgagacggcagaatgccccaacacaaatagagcttggaactcgttggaggttgaagactacggcttcggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggcaagcttgagatggactttgatttctgcgatggaaccacagtgatagtgaccgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaattctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatctcgccctactagcagccttcaaagttagaccaacttttgcagctggactactcttgagaaagctgacctccaaggaattgatgatgactaccataggaattgtactcctctcccaaagcactataccagagaccattcttgaattgactgatgcgttagccttaggcatgatggtcctcaaaatagtaagagacatggaaaagtatcaattagcagtgactattatggctatcttgtgcgtcccaaacgcagtgatattacagaatgcatggaaagtgagttgcacaatactggcagtggtgtccgtttccccactgcttttgacatcttcacagcaaaaaacggattggataccattagcattgacaattaagggtctcaatccaacagccatctttctaacaaccctctcaagaaccaacaagaaaaggagctggccactaaatgaggccatcatggcagtcggaatggtgagcattttagccagttccctcctgaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcatcagaacaggattgctggtgatctcaggactttttcctgtatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgcggttctaatgcataaaggaaagaggattgaaccttcatgggcggatgtcaaaaaagatctaatatcatatggaggaggctggaagttagaaggagaatggaaggaaggagaagaagtccaggtgctggcactggagcctggaaaaaatccaagagccgttcaaacaaaacctggtcttttcaaaaccaacaccggaacaataggtgccgtgtctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccaataagataccaaaccccagctatcagagctgagcacactgggcgggaaattgtggatttaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggttacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctttggaaaatgatgaagactgtgcacactggaaagaagccaaaatgctcctagacaacattaacacaccagaaggaatcattcccagtatgtttgaaccagagcgtgaaaaagtggatgccattgatggcgaataccgcttgagaggagaagcaaggaaaacctttgtggacttaatgaggagaggagacctaccagtctggttggcttacaaagtggcagctgaaggcatcaactatgcagacagaaggtggtgttttgatggaattaagaacaaccaaatcctggaagaaaatgtggaagttgaaatctggacaaaagaaggagaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgctcttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactagagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagtaacatcctggacatagatctacgtcccgcatcagcttggacgctgtatgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctctcattggtagcgcattatgccatcatagggccaggacttcaagcaaaagcaaccagagaagcccagaaaagagcagcggcgggcatcatgaaaaatccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaatgcactgggaaaaagtgaattccagacctacaagaaaagtggaatccaggaagtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatacgggtggaatctagtgcgtctccagagcggagttgacgtcttcttcatcccgccagaaaagtgtgacacattgttgtgtgacataggggagtcatcaccaaatcccacagtggaagcaggacgaacactcagagtccttaacttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcggtgaacatgatttcaaggatgttgatcaacagattcacaatgagacacaagaaagccacttacgagccggatgttgacctcggaagcggaacccgcaacattggaattgaaagtgaaataccaaacctagacataattgggaaaagaatagaaaaaataaagcaagagcatgaaacatcatggcactacgatcaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaattaatgaaaatcacagcagaatggctgtggaaagaattggggaagaaaaagacacctaggatgtgcaccagagaagaattcacaagaaaggtgagaagcaatgcagccttgggggccatattcactgacgagaataagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtacgccgacgacacagcaggatgggacacaagaatcacactagaagacttaaaaaatgaagaaatggtaacaaaccacatggaaggagaacacaagaaattagccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagccacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggctaacaagcagggccacatgggcaaagaacatccaagcagcaataaatcaagttagatctcttataggcaatgaggaatacacagattacatgccatccatgaaaagattcagaagagaagaggaagaagcaggagtcctgtggtaa

SEQ ID NO: 6534 - RNA, 9876 nt, synthetic construct
  misc_feature 1..9876: note = derived and/or modified CDS sequence (wt) from DENV-2__FJ639706__SS-prME
  source 1..9876: mol_type = other RNA
tctgcaggcatgatcattatgctgattccaacagtgatggcgttccatctaaccacacgtaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacttgtactactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcttggcatacaccatagggacgacacatttccagagagccctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaatacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacagggaaacacggcaaagaaatcaaagtaacaccacagagttccatcacagaagctgaattgacaggttatggcaccgtcacgatggagtgctctccgagaacaggcctcgacttcaatgagatggtgttgctgcagatggaaaataaagcttggctggtgcataggcaatggttcctagacctgccattaccgtggctgcccggagcggacaaacaagggtcaaattggatacagaaagaaacattggtcactttcaaaaatccccatgcaaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatacgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcaaagagaatggccattttgggtgacacagcctgggacttcggctccctaggaggagtgtttacatctataggaaaagctctccaccaagtctttggagcaatctatggagctgccttcagtggggtttcatggactatgaaaatcctcataggagtcattatcacatggataggaatgaactcacgcagcacttcactgtctgtgtcactagtattggtgggaattgtgacactgtatttgggagtcatggtgcaggccgatagtggttgcgttgtgagctggaaaaacaaagaactgaaatgtggcagcgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccccgagacggcagaatgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggcaagcttgagatggactttgatttctgcgacggaaccacagtgatagtgaccgaggactgcggaaatagaggaccctctttgagaacaaccactgcctctggaaaactcataacagaatggtgctgccgatcttgcacattaccacccctaagatacagaggtgaggatgggtgctggtacgggatggaaatcagaccattgaaagagaaagaagaaaatctggttaattctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactactcttgagaaagctgacctccaaggaattgatgatgaccaccataggaattgcactcctctcccaaagcactataccagagaccattcttgaattgactgatgcgttagccttaggcatgatggtcctcaaaatagtaagagacatggaaaagtatcaattagcagtgactattatggctatcttgtgcgtcccaaacgcagtgatattacagaatgcatggaaagtgagttgcacaatactggcagtggtgtccgtctccccactgcttttgacatcttcacagcaaaaaacggattggataccattagcattgacaattaagggtctcaatccaacagccatctttctaacaaccctctcaagaaccaacaagaaaaggagctggccactaaatgaggccatcatggcagtcggaatggtgagcattttagccagttccctcctgaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaattctgtcaataacaatatcagaagatggtagcatgtcgataaaaaatgaagaggaagaacaaacactgaccatactcatcagaacaggattgctggtgatctcaggactttttcctgtatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgttcaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccaataagataccaaaccccagctatcagagctgagcacactgggcgggaaattgtggatttaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggttacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaactaatgattgggatttcgtggttacaactgacatttcagaaatgggtgccaatttcaaagctgagagggttatagaccccagacgctgcatgaaaccagtcatactaacagatggtgaggagcgggtgattctagcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagacaacattaacacaccagaaggaatcattcccagtatgtttgaaccagagcgtgaaaaagtggatgccattgatggcgaataccgcttgagaggagaagcaaggaaaacctttgtggacttaatgaggagaggagacctaccagtctggttggcttacaaagtggcagctgaaggcatcaactatgcagacagaaggtggtgttttgatggaatcaagaacaaccaaatcctggaagaaaatgtggaagttgaaatctggacaaaagaaggagaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgctcttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcttggacgctgtatgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaatccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaatgcactgggaaaaagtgaattccagacctacaagaaaagtggaatccaggaagtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtctccagagcggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcggtgaacatgatttcaaggatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggcactacgatcaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaattaatgaaaatcacagcagaatggctgtggaaagaattagggaagaaaaagacacctaggatgtgcaccagagaagaattcacaagaaaggtgagaagcaatgcagccttgggggccatattcactgacgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtacgccgacgacacagcaggatgggacacaagaatcacactagaagacttaaaaaatgaagaaatggtaacaaaccacatggaaggagaacacaagaaattagccgaggctattttcaaactaacgtatcaaaacaaggtggtgcgtgtgcaaagaccaacaccaagaggcacagtaatggacatcatatcgagaaaagaccaaagaggtagtgggcaagttggtacctatggactcaatactttcaccaatatggaagcccaattaatcagacagatggagggagaaggagtcttcaaaaacatccagcacctgacagccacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgatatgggaaagattagaaaagatatacaacaatgggaaccttcaaaaggatggaacgattggacacaagtgcccttctgttcacaccatttccatgagctaatcatgaaggatggtcgtgtactcgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggctaacaagcagggccacatgggcaaagaacatccaagcagcaataaaccaagttagatctcttataggcaatgaggaatacacagattacatgccatccatgaaaagattcagaagagaagaggaagaagcaggagtcctgtggtaa

SEQ ID NO: 6535 - RNA, 9876 nt, synthetic construct
  misc_feature 1..9876: note = derived and/or modified CDS sequence (wt) from DENV-2__FJ639707__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggacaagaggttcgtctgcaaacactccatggtagacagaggatggggaaatggatgtggattatttggaaaggggggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatatcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatctctgggaggagtgtttacatctataggaaaagctctccaccaagtctttggagcaatctatggagctgccttcagtggggtttcatggaccatgaaaatcctcataggagtcattatcacatggataggaatgaactcacgtagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggaaaagcaaaaatgctctccacagagtcttataaccaaacctttctcattgatggccccgagacgacagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctcttttattgaagtaaaaaactgccactggccaaaatcacacaccctctggagcaatggagtgctagaaagtgagatgataattccaaagaatctcgctggaccagtgtctcaacacaactacagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctagaggaaatgcttaggacccgagtaggaacgaaacatgcaatattactagttgcagtttcttttatgacattgatcacagggaacatgtccttcaaagacctaggaagagtggtggttatggtaggcgctaccatggcggatgacataggtatgggcgtgacttatcttgccctactagcagctttcaaagttagaccaacttttgcagctggactactcttgagaaagctgacctccaaggaattgatgatgaccaccataggaattgtactcctctcccaaagcactataccagagaccgttcttgaattgactgatgcgttagccttaggcatgatggtccttaaaatagtaagaaacatggaaaagtatcaactagcagtgacgatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagcggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaagaagaacaaacactgaccatactcattagaacaggattgctggtgatctcaggactttttcctatatcaataccaatcacggcagcagcatggtacctgtgggaagtgaagaaacaacgggccggagtattgtgggacgttccctcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagcatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgccaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacatcaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggattctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattgggaagcattgcaacccagcaacccgagagcaacatcctggacatagatctacgtcccgcatcagcttggacgctgtatgccgtggctacaacattcgttacaccaatgctgagacatagtattgagaattcctcagtgaatgtatccctaacagctatagccaaccaagcaacagtgttagtgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccatagcggtgtcaatggctaacatctttagagggagttacttggctggagctggacttctcttttccattatgaagaacacaaccaacacaagaaggggaactggcaacataggagaaacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgctgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccctagtgagaaatccactctcacggaactccacacatgagatgtactgggtatccaatgcttctgggaacatagtgtcatcagtgaacatgatttcaaggatgttgatcaatagatttacaatgagacacaagaaagccacttacgagccggatgttgacctcggaagcggaacccgtaacattggaattgaaagtgaagtaccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaatggagtggtcaggctgctgacaaaaccttgggacgtcctccccacggtgacacagatggcaatgacagacacgactccatttggacaacagcgtgtttttaaagaaaaagtagacacgagaacccaagaaccgaaagaaggtacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgactggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacctgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6536 - RNA, 9876 nt, synthetic construct
  misc_feature 1..9876: note = derived and/or modified CDS sequence (wt) from DENV-2__FJ639708__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggacaagaggttcgtctgcaaacactccatggtagacagaggatggggaaatggatgtggattatttggaaaggggggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatatcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatctctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggaaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactacagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttatgacattgatcacagggaacatgtccttcaaagacctaggaagagtggtggttatggtaggcgctaccatggcggatgacataggtatgggcgtgacttatcttgccctactagcagctttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagcatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacatcaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagatctacgtcccgcatcagcttggacgctgtatgccgtggctacaacattcgttacaccaatgctgagacatagtattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgctgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccctagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgtaacattggaattgaaagtgaagtaccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaatggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacctgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6537 - RNA, 9876 nt, synthetic construct
  misc_feature 1..9876: note = derived and/or modified CDS sequence (wt) from DENV-2__FJ639709__SS-prME
  source 1..9876: mol_type = other RNA
tctgcaggcatgatcattatgctgattccaacagtgatggcgttccatctaaccacacgtaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacttgtactactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcttggcatacaccatagggacgacacatttccagagagccctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaatacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacagggaaacacggcaaagaaatcaaagtaacaccacagagttccatcacagaagctgaattgacaggttatggcaccgtcacgatggagtgctctccgagaacaggcctcgacttcaatgagatggtgttgctgcagatggaaaataaagcttggctggtgcataggcaatggttcctagacctgccattaccgtggctacccggagcggacaaacaagggtcaaattggatacagaaagaaacattggtcactttcaaaaatccccatgcaaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatacgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcaaagagaatggccattttgggtgacacagcctgggacttcggctccctaggaggagtgtttacatctataggaaaagctctccaccaagtctttggagcaatctatggagctgccttcagtggggtttcatggactatgaaaatcctcataggagtcattatcacatggataggaatgaactcacgcagcacttcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccccgagacggcagaatgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggcaagcttgagatggactttgatttctgcgatggaaccacggtgatagtgaccgaggattgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaattctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccgacttttgcagctggactactcttgagaaagctgacctccaaggaattgatgatgactaccataggaattgtactcctctcccaaaccactataccagagaccattcttgaattgactgatgcgttagccttaggcatgatggtcctcaaaatagtaagagacatggaaaagtatcaattagcagtgactattatggctatcttgtgcgtcccaaacgcagtgatattacagaatgcatggaaagtgagttgcacaatactggcagtggtgtccgtttccccactgcttttgacatcttcacagcaaaaaacggattggataccattagcattgacaattaagggtctcaatccaacagccatctttctaacaaccctctcaagaaccaacaagaaaaggagctggccactaaatgaggccatcatggcagtcggaatggtgagcattttagccagttccctcctgaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcatcagaacaggattgctggtgatctcaggactttttcctgtatcaataccaatcacggcagcagcatggtacctgtgggaagtgaagaaacaacgggccggagtattgtgggacgttccttcacctccacccatgggaaaggctgaactggaagatggagcctatagaatcaagcaaaaagggattcttggatattctcagatcggagctggagtttacaaagaaggaacattccatacaatgtggcatgtcacacgtggcgctgttctaatgcacaaaggaaagaggattgaaccttcatgggcggacgtcaaaaaagatctaatatcatatggaggaggctggaagttagaaggagaatggaaggaaggagaagaggtccaggtgctggcactggagcctggaaaaaatccaagagccgttcaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccaataagataccaaaccccagctatcagagctgagcacactgggcgggaaattgtggatttaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggttacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggtcatagaccccagacgctgcatgaaaccagtcatactaacagatggtgaggagcgggtgattctggcaggacctatgccagtgacccactctagtgcagcgcaaagaagagggagaataggaagaaatccaaaaaatgaaaatgaccagtacatatacatgggagaacctctggaaaatgatgaagactgtgcacactggaaagaagccaaaatgctcctagacaacattaacacaccagaaggaatcattcccagtatgtttgaaccagagcgtgaaaaagtggacgccattgatggcgaataccgcttgagaggagaagcaaggaaaacctttgtggacttaatgaggagaggagacctaccagtctggttggcttacaaagtggcagctgaaggcatcaactatgcagacagaaggtggtgttttgatggaattaagaacaaccaaatcctggaagaaaatgtggaagttgaaatctggacaaaagaaggagaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaaaacaagagacgcactggacaacctagcagtgctgcacacggctgaagcaggtggaagggcgtacaatcatgctctcagtgaactgccggagaccctagagacactgctcttactgacacttctggctacagtcacaggagggatctttttattcttgatgagcgggaggggcatagggaagatgaccctgggaatgtgctgcataatcacggctagcatccttctatggaacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcttggacgctgtatgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaatccaaccgtcgatggaataacagtgattgatttagatccaataccttatgatccaaagtttgaaaagcagttgggacaagtaatgctactaatcctctgcgtgactcaagtattgatgatgaggactacatgggctctgtgtgaggccttaactttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaatgcactgggaaaaagtgaattccagacctacaagaaaagtggaatccaggaagtggatagaaccttagcaaaagaaggcatcaaaagaggagaaacggaccatcacgctgtgtcgcgaggctcagcaaaactgagatggttcgttgagagaaatatggtcacaccagaagggaaagtagtggatctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtctccagagcggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggcactacgatcaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaattaatgaaaatcacagcagaatggctgtggaaagaattagggaagaaaaagacacctaggatgtgcaccagagaagaattcacaagaaaggtgagaagcaatgcagccttgggggccatattcactgacgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagcactaggattcctaaatgaagatcactggttctccagagagaactccctgagtggagtggaaggagaagggctgcacaagctaggttacattctaagagacgtgagcaagaaagagggaggagccatgtacgccgacgacacagcaggatgggacacaagaatcacactagaagacttaaaaaatgaagaaatggtaacaaaccacatggaaggagaacacaagaaattagccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagccacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgcttggggaagtcttacgcccaaatgtggagcctgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggctaacaagcagggccacatgggcaaagaacatccaagcagcaataaatcaagttagatctcttataggcaatgaggaatacacagattacatgccatccatgaaaagattcagaagagaagaggaagaagcaggagtcctgtggtaa

SEQ ID NO: 6538 - RNA, 9876 nt, synthetic construct
  misc_feature 1..9876: note = derived and/or modified CDS sequence (wt) from DENV-2__FJ639710__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacacagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggagccattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggcaaggaaatcaaagtaacaccacagagttccatcacagaagcagaattgacaggttatggcaccgtcacgatggagtgctctccaagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacactggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcattataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactaatactggtgggaattgtgacactgtatttgggagtcatggtgcaggccgatagtggctgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaactatcatgacaggagacatcaaaggaatcatgcaggcaggaagacgatctttgcggcctcagcctactgagctaaagtattcatggaaaacatggggaaaagcaaaaatgctctccacagagtcttataaccaaacttttctcattgatggccccgaaacgacagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatggatgctggtacgggatggaaatcagaccattgaaagagaaagaagaaaatctggttaactccttggtcacagctggacatgggcaggttgacaatttttcactgggagtcctgggaatggcattgttcctggaggaaatgcttaggacccgagtaggaacgaaacatgcaatactactagttgcagtttcttttgtgacattgatcacagggaacatgtccttcaaagacctaggaagagtggtagttatggtaggcgccaccatggcggatgacataggtatgggcgtgacttatcttgccctactagcagccttcaaagttagaccaacttttgcagctggactactcttgagaaagctgacctccaaggaattgatgatgaccaccataggaattgtactcctctcccaaagcactataccagagaccattcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaaggagctggccactaaatgaggctatcatggcagtcggaatggtgagcattttagccagttccctcctaaagaatgatattcccatgacaggaccactagtggctggagggctcctcactgtgtgctacgtgctcactggacgatcggccgacttggaactggagagagcaaccgatgtcaaatgggaagaacaggcagagatatcaggaagcagtccaatcctgtcaataacaatatcagaagatggtagcatgtcgataaaaaatgaagaggaagaacaaacactgaccatactcattagaacaggattgctggtgatctcaggacttttccctatatcaataccaatcacggcagcagcatggtacctgtgggaagtgaagaaacaacgggccggagtattgtgggacgttccttcacccccacccatgggaaaagctgaactggaagatggagcctatagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccattttacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtggatcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgatcagtacatatacatgggtgaacctctggaaaatgatgaagactgtgcacactggaaagaagccaaaatgctcctagataacattaacacaccagaaggaatcattcccagtatgtttgaaccagagcgtgaaaaagtggatgccattgatggcgaataccgtttgagaggagaagcaaggaaaacctttgtggacctaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctaggaatgtgctgcataatcacggccagcatccttctatggtacgcacaaatacagccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaacgaagaaagatcttggattaggaagcattgcaacccagcaacccgagagcaacatcctggacatagatctacgtcccgcatcagcttggacgctgtatgccgtggctacaacattcattacaccaatgctgagacatagcattgagaattcttcagtgaatacatccctaacagctatagccaaccaagcaacagtattaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatttccacactgtgggaaggaaatccaggaaggttttggaacactaccattgcggtgtcaatggctaacatttttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaggtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaaaagaagtgaaaggcctaacaaaaggaggaccaggacacgaagaacccatccctatgtcaacatatgggtggaatctagtgcgtcttcagagtggagttgatgtcttcttcatcccgccagagaagtgtgacacattgttgtgtgacataggggagtcatcaccaaatcccacagtggaagcaggaagaacactcagagtccttaatttagtagaaaattggttgaacaacaacactcaattttgcataaaagttctcaacccatacatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaacagattcacaatgagacacaagaaagccacctacgagccggatgttgacctcggaagcggaacccgtaacattggaattgaaagtgaagtaccaaacctagacataattgggaaaagaatagaaaaaataaagcaagagcatgaaacatcatggcactacgaccaagaccatccatacaaaacgtgggcataccatggtagctatgaaacaaaacaaactggatcagcatcatccatggtcaacggagtggtcaggctgctgacaaaaccttgggacgtccttcccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacgtgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtacgccgacgatacagcaggatgggacacaagaatcacactagaagacctaaaaaatgaagaaatggtaacaaaccacatggaaggagaacacaagaaattagccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaattagacagatggagggagaaggagtctttaaaaacatccagcacctgacagtcacagaagaagttgccgtgcagaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggagccttcaaaaggatggaacgattggacacaagtgcccttctgttcacaccatttccatgagctgatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatatatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggctacatgggcaaagaacatccaagcagcaataaatcaggttagatctcttataggcaatgaggaatacacagattacatgccatccatgaaaagatttagaagagaagaggaagaagcaggagtcctgtggtaa

SEQ ID NO: 6539 - RNA, 9876 nt, synthetic construct
  misc_feature 1..9876: note = derived and/or modified CDS sequence (wt) from DENV-2__GQ868623__SS-prME
  source 1..9876: mol_type = other RNA
tctgcaggcatgatcattatgctgattccaacggtgatggcgttccatctaaccacacgtaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacttgtactactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcttggcatacaccatagggacgacacatttccagagagccctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaatacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacagggaaacacggcaaagaaatcaaagtaacaccacagagttccatcacagaagctgaattgacaggttatggcaccgtcacgatggagtgctctccgagaacaggcctcgacttcaatgagatggtgttgctgcagatggaaaataaagcttggctggtgcataggcaatggttcctagacctgccattaccgtggctacccggagcggacaaacaagggtcaaattggatacagaaagaaacattggtcactttcaaaaatccccatgcaaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatacgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcaaagagaatggccattttgggtgacacagcctgggacttcggctccctaggaggagtgtttacatctataggaaaagctctccaccaagtctttggagcaatctatggagctgccttcagtggggtttcatggactatgaaaatcctcataggagtcattatcacatggataggaatgaactcacgcagcacttcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcgaaaatgctctccacagagtctcataaccaaacctttctcattgatggccccgagacggcagaatgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggcaagcttgagatggactttgatttctgcgatggaaccacagtgatagtgaccgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaattctttggtcacagccggacatgggcaggttgacaatttttcactgggagtcttgggactggcattgttcctggaggaaatgcttaggacccgagtaggaacgaaacatgcaatactactagttgcagtttcttttgtgacattgatcacagggaacatgtccgtcaaagacctaggaagagtagtggttatggtaggcgccaccatgacggatgacataggtatgggcgtgacttatcttgccctactagcagccttcaaagttagaccgacttttgcagctggactactcttgagaaagctgacctccaaggaattgatgatgactaccataggaattgtactcctctcccaaagcactataccagagaccattcttgaattgactgatgcgttagccttaggcatgatggtcctcaaaatagtaagagacatggaaaagtatcaattagcagtgactattatggctatcttgtgcgtcccaaacgcagtgatattacagaatgcatggaaagtgagttgcacaatactggcagtggtgtccgtttccccactgcttttgacatcttcacagcaaaaaacggattggataccattagcattgacaattaagggtctcaatccaacagccatctttctaacaaccctctcaagaaccaacaagaaaaggagctggccactaaatgaggccatcatggcagtcggaatggtgagcattttagccagttccctcctgaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcatcagaacaggattgctggtgatctcaggactttttcctgtatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctgggaaaaatccaagagccgttcaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccaataagataccaaaccccagctatcagagctgagcacactgggcgggaaattgtggatttgatgtgtcatgccacatttaccatgaggctgctatcaccagttagagtgccaaactataacttgattatcatggacgaagcccatttcacagacccagcaagtatagcagctagaggatatatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggttacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggtcatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagacaacattaacacaccagaaggaatcattcccagtatgtttgaaccagagcgtgaaaaagtggatgccattgatggcgaataccgcttgagaggagaagcaaggaaaacctttgtggacttaatgaggagaggagacctaccagtctggttggcttacaaagtggcagctgaaggcaccaactatgcagacagaaggtggtgttttgatggaattaagaacaaccaaatcctggaagaaaatgtggaagttgaaatctggacaaaagaaggagaaaggaagaaattgaaacccagatggttggatgctaggatctactctgacccactggcgctaaaagaattcaaagaatttgcagctggaagaaagtctctgaccctgaacctaatcacagaaatgggtaggcttccaacattcatgactcagaaaacaagagacgcactggacaacctagcagtgctgcacacggctgaagcaggtggaagggcgtacaatcatgctctcagtgaactgccggagaccctagagacactgctcttactgacactcctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcttggacgctgtatgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaatccaaccgtcgatggaataacagtgattgatttagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatttttagagggagttacttggctggagctggacttctcttttccattatgaagaacacaaccaacacaagaaggggaactggcaacataggagagacgcttggagagaaatggaaaagccgattgaatgcactgggaaaaagtgaattccagacctacaagaaaagtggaatccaggaagtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtctccagagcggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaacatggaggagccttagtgagaaatccactctcacggaactccacacatgagatgtactgggtatccaatgcttctgggaacatagtgtcatcagtgaacatgatttcaaggatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggcactacgatcaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaattaatgaaaatcacagcagaatggctgtggaaagaattagggaagaaaaagacacctaggatgtgcaccagagaagaattcacaagaaaggtgagaagcaatgcagccttgggggccatattcactgacgagaacaagtggaagtcggcacgtgaggctgttgaagatagtaggttttgggagctggttgacagggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagcactaggattcctaaatgaagatcactggttctccagagagaactccctgagtggagtggaaggagaagggctgcacaagctaggttacattctaagagacgtgagcaagaaagagggaggagccatgtacgccgacgacacagcaggatgggacacaagaatcacactagaagacttaaaaaatgaagaaatggtaacaaaccacatggaaggagaacacaagaaattagccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattgatcagacagatggagggagaaggagtctttaaaaacatccagcacctgacagccacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgcttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggctaacaagcagggccacatgggcaaagaacatccaagcagcaataaatcaagttagatctcttataggcaatgaggaatacacagattacatgccatccatgaaaagattcagaagagaagaggaagaagcaggagtcctgtggtaa

SEQ ID NO: 6540 - RNA, 9876 nt, synthetic construct
  misc_feature 1..9876: note = derived and/or modified CDS sequence (wt) from DENV-2__GQ868624__SS-prME
  source 1..9876: mol_type = other RNA
tctgcaggcatgatcattatgctgattccaacagtgatggcgttccatctaaccacacgcaatggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcggcaatcctggcatacaccatagggacgacacatttccagagagtcctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtgacacctcactcaggggaagagcatgcggtcggaaatgacacaggaaaacacggcatggaaatcaaagtaacaccacagagctccatcacagaagcagaattgacaggttatggcaccgtcacgatggagtgctccccgagaacaggcctcgacttcaatgagatggtgttactgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactctatgtgcacaggaaagtttaaagttgtgaaggaaatagcagaaacacaacatggaacgatagttatcagagtgcaatatgaaggggacggctctccatgcaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatccataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcattacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaaccatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccctgagacagcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgtacattaccacccctaagatacagaggtgaggatgggtgctggtacgggatggaaatcagaccattgaaagagaaagaagaaaatctggttaactccttggtcacagccggacatgggcaggttgacaatttttcactaggagtcttgggaatggcattattcctggaggaaatgcttaggacccgagtaggaacgaaacatgcaatactactagttgcagtttcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactacttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgcttactggacgatcggccgacttggaactggagagagcaaccgatgtcaaatgggaagaccaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctatatcaataccaatcacagcagcagcgtggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcctccgggaagtagagatccatttccccagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgaggaaaaatggaaagaaagtaatacaacttagtagaaagacctttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaacgtggaagttgaaatctggacaaaagaaggggaaaggaagaaattgaaacccagatggttggatgctaggatctactctgacccactggcgctaaaagaattcaaagaatttgcagccggaagaaagtctctgactctgaacctaatcacagaaatgggtaggcttccaacattcatgactcagaagacaagagatgcactggacaacctagcagtgctgcacacggctgaagcaggtggaagggcgtacaatcatgctctcagtgaactaccggagaccctagagacactgcttttactgacacttctggctacagtcacaggagggatctttttattcttgatgagtgggaggggcatagggaagatgaccctaggaatgtgctgcataatcacggctagcatccttctatggtacgcacaaatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcttagaaaaaacgaagaaagatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctattattggtagcgcattatgccatcatagggccaggacttcaagcaaaagcaaccagagaagcccagaaaagagcagcggcaggcatcatgaaaaacccaaccgtcgatggaataacagtgattgatctagatccaataccttatgatccaaagtttgaaaagcagttaggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagaaacgcttggagagaaatggaaaagccgattgaacgcactgggaaaaagtgaattccaaatctacaagaaaagtggaatccaggaagtggatagaaccttagcaaaagaaggcatcaaaagaggagaaacggaccatcatgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaacgcttctgggaacatagtgtcatcagtgaacatgatttcaaggatgttgatcaatagattcacaatgagacacaagaaagctacttacgagccggatgttgacctcggaagcggaacccgtaacattggaattgaaagtgaaataccaaacttagacataattgggaaaagaatagaaaaaataaaggaagagcatgaaacatcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttatattctaagagacgtgagcaagaaagagggaggagccatgtacgccgacgacacagcaggatgggacacaagaatcacattagaagacctaaaaaatgaagaaatggtaacaaaccacatggaaggagaacataagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagctgccgtgcaaaactggttggctagagtggggcgcgaaaggttgtcaagaatggccatcagtggagatgattgtgttgtgaaacctttagatgacaggttcgcaaacgctttgacagctctgaatgacatgggaaagattagaaaagacatacaacaatgggaaccttcaaaaggatggaacgattggacacaagtgcccttctgttcacaccatttccatgagctaatcatgaaggatggtcgtgtacttgttgttccatgtagaaatcaagatgaactgattggcagagcccgaatctcccaaggagcagggtggtctttgcgggagacggcctgtttggggaagtcttacgcccaaatgtggagcttaatgtatttccacaggcgtgacctcaggctggcggcaaatgccatttgctcggcagtgccatcacactgggttccaacaagtcgaacaacctggtccatacacgctaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaggcaggagttctgtggtaa

SEQ ID NO: 6541 - RNA, 9876 nt, synthetic construct
  misc_feature 1..9876: note = derived and/or modified CDS sequence (wt) from DENV-2__FJ639717__SS-prME
  source 1..9876: mol_type = other RNA
tctgcaggcatgatcattatgctgattccaacagtgatggcgttccatctaaccacacgtaacggagaaccacacatgatcgtcggtatacaggagaaagggaaaagtcttctgttcaaaacagaggatggtgtgaacatgtgcaccctcatggctatggaccttggtgaattgtgtgaagacacaatcacatacaagtgtcctctgctcaggcagaatgagccagaggacatagactgttggtgcaactccacgtccacgtgggtaacctatgggacttgtactaccacgggagaacatagaagagaaaaaagatcagtggcactcgttccacatgtgggaatgggactggagacgcgaaccgaaacatggatgtcgtcagaaggggcttggaaacatgcccagagaattgaaacttggatcctgagacatccaggcttcaccataatggcagcaatcttggcatacaccatagggacgacacatttccagagagccctgattttcattctattgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaatacaacaacagaatcccgttgcccaacacaaggggaacccagcctaaaagaagagcaggataagaggttcgtctgcaaacactccatggtagacaggggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacagggaaacacggcaaggaaatcaaagtaacaccacagagttccatcacagaagctgaattgacaggttatggcaccgtcacgatggaatgctctccgagaacaggcctcgacttcaatgagatggtgttgctgcagatggaaagtaaagcttggctggtgcataggcaatggttcctagacctgccattaccgtggctgcccggagcggacaaacaagggtcaaattggatacagaaagaaacattggtcactttcaaaaatccccatgcaaagaaacaggatgttgttgttttaggatctcaagaaggggccatgcatacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatacgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggagcaaagagaatggccattttgggtgacacagcctgggactttggctccctaggaggagtgtttacatctataggaaaagctctccaccaagtctttggagcaatctatggagctgccttcagtggggtttcatggactatgaaaatcctcataggagtcattattacatggataggaatgaactcacgcagcacttcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccccgagacggcagaatgccctaacacaaatagagcttggaactcgttggaggttgaagactacggctttggagtgttcaccaccaatatatggctaaaattgaaagagaaacaggatgcattctgcgactcaaaactcatgtcagcagccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactataggccaggctaccacacacaaacagcaggaccatggcatctaggcaagcttgagatggactttgatttctgcgatggaaccacagtgatagtgaccgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaattctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcaccaccatgacggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccattcttgaattgactgatgcgttagccttaggcatgatggtcctcaaaatagtaagagacatggaaaagtatcaattagcagtgactattatggctatcttgtgcgtcccaaacgcagtgatattacagaatgcatggaaagtgagttgcacaatactggcagtggtgtccgtttccccactgcttttgacatcttcacagcaaaaaacggattggataccattagcattgacaattaagggcctcaatccaacagccatctttctaacaaccctctcaagaaccaacaagaaaaggagctggccactaaatgaggccatcatggcagtcggaatggtgagcattctagccagttccctcctgaaaaatgacattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcatcagaacaggattgctggtgatctcaggactttttcctgtatcaataccaatcacggcagcagcatggtacctgtgggaagtgaagaaacaacgggccggagtattgtgggacgttccctcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgttcaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccgataagataccaaaccccagctatcagagctgagcacactgggcgggaaattgtggatttaatgtgtcatgccacatttaccatgaggctgctatcaccagttagagtgccaaactacaacttgattatcatggacgaagcccatttcacagacccagcaagtatagcagctagaggatacatctcgacacgagtggagatgggtgaggcagctgggattttcatgacagccactcccccgggaagtagagatccatttcctcagagcaatgcaccaatcatagatgaagaaagagaaatccctgagcgttcatggaatactggacatgagtgggttacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgactgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaacccaaaaaatgaaaatgaccagtacatatacatgggagaacctctggaaaatgatgaagactgtgcacactggaaagaagccaaaatgctcctagacaacattaacacaccagaaggaatcattcccagtatgtttgaaccagagcgtgaaaaagtggatgccattgatggcgaataccgcttgagaggagaagcaaggaaaacctttgtggacttaatgaggagaggagacctaccagtctggttggcttacaaagtggcagctgaaggcatcaactatgcagacagaaggtggtgttttgatggaattaagaacaaccaaatcctggaagaaaatgtggaagttgaaatctggacaaaagaaggagaaaggaagaaattgaaacctagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgctcttactgacacttctggctacagtcacaggagggatctttttattcttgatgagcggaaggggcatagggaagatgaccctgggaatgtgctgcataatcacggctagcgtccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcctggacgctgtatgccgtggctacaacatttgttacaccaatgctgaggcatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaatccaactgtcgatggaataacagtgattgatctagatccaataccttatgatccaaagtttgaaaagcagttgggacaggtaatgctactaatcctctgcgtgactcaagtattgatgatgaggactacatgggctctgtgtgaggccttgaccttagctacagggcccatctccacactgtgggaaggaaatccaggaaggttctggaacactaccattgcggtgtcaatggctaacatctttagagggagttacttggctggagctggacttctcttttccattatgaagaacacaactaacacaagaaggggaactggcaacataggagagacgcttggagagaaatggaaaagccgattgaatgcactgggaaaaagtgaattccagacctacaagaaaagtggaatccaagaagtggatagaaccttagcaaaagaaggcatcaagagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaatgtaagagaagtgaaaggcctaacaaaaggaggaccaggacacgaagaacccatccctatgtcaacatatgggtggaatctagtgcgtctccagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcggtgaacatgatttcaaggatgttgatcaacagattcacaatgagacacaagaaagccacttacgagccggatgttgacctcggaagcggaacccgtaacattggaattgaaagtgaaataccaaacctagacataattgggaaaagaatagaaaaaataaaacaagagcacgaaacatcatggcactacgatcaagaccacccatacaaaacgtgggcataccatggtagctatgaaacaaaacagactggatcagcatcatccatggtcaacggagtggtcaggctactaacaaaaccttgggacgtcctccccacggtgacacagatggcaatgacagacacgactccatttggacaacagcgtgtttttaaagaaaaagtggacacgagaacccaagaaccgaaagaaggcacgaagaaattaatgaaaatcacagcagaatggctgtggaaagaattagggaagaaaaagacacctaggatgtgcaccagagaagaattcacaagaaaagtgagaagcaatgcagccttgggggccatattcactgacgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagaaggaggagccatgtacgccgacgacacagcaggatgggacacaagaatcacactagaagacttaaaaaatgaagaaatggtaacaaaccacatggaaggagaacacaaaaaattagccgaggctattttcaaactaacgtatcaaaacaaggtggtgcgtgtgcaaagaccaacaccaagaggcacagtaatggacatcatatcgagaagagaccaaagaggcagtgggcaagttggtacctatggactcaatactttcaccaatatggaagcccaattaatcagacagatggagggagaaggagtctttaaaaacatccagcacctgacagccacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgcagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggctgcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggctaacaagcagggccacatgggcaaagaacatccaagcagcaataaatcaagttagatctcttataggcaatgaggaatacacagattacatgccatccatgaaaagattcagaagagaagaggaagaagcaggagtcctgtggtaa

SEQ ID NO: 6542 - RNA, 9876 nt, synthetic construct
  misc_feature 1..9876: note = derived and/or modified CDS sequence (wt) from DENV-2__FJ639718__SS-prME
  source 1..9876: mol_type = other RNA
tctgcaggcatgatcattatgctgattccaacagtgatggcgttccatctaaccacacgcaatggagaaccacacatgatcgtcggtatacaggagaaagggaaaagtcttctgttcaaaacagaggatggtgtgaacatgtgcaccctcatggccatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcggcaatcctggcatacaccatagggacgacacatttccagagagtcctgattttcatcctactgacagctgtcgctccttcgatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtgacacctcactcaggggaagagcatgcggtcggaaatgacacaggaaaacacggcatggaaatcaaagtaacaccacagagctccatcacagaagcagaattgacaggttatggcaccgtcacgatggagtgctccccgagaacaggcctcgacttcaatgagatggtgttactgcagatggaaaataaagcttggctggtgcataggcaatggtttctagacctgccattaccatggctgcccggagcggataaacaagagtccaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactctatgtgcacaggaaagtttaaagttgtgaaggaaatagcagaaacacaacatggaacgatagttatcagagtgcaatatgaaggggacggctctccatgcaaaatcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggttcaagaaaggaagttccatcggccaaatgtttgagacaacgatgagaggggcgaagagaatggccattttgggtgacacagcctgggacttcggatccctgggaggagtgtttacatccataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcattacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaaccatcatgacaggagacatcaaaggaatcatgcaggcaggaaaacgatctctgcggcctcagcccactgagctaaagtattcatggaaaacatggggtaaagcaaaaatgctctccacagagtcttataaccaaacctttctcattgatggccctgagacagcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgctgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatcttgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgtacattaccacccctaagatacagaggtgaggatgggtgctggtacgggatggaaatcagaccattgaaagagaaagaagaaaatctggttaactccttggtcacagccggacatgggcaggttgacaatttttcactaggagtcttgggaatggcattattcctggaggaaatgcttaggacccgagtaggaacgaaacatgcaatactactagttgcagtttcctttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactacttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgcttactggacgatcggctgacttggaactggagaaagcaaccgatgtcaaatgggaagaccaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctatatcaataccaatcacagcagcagcgtggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcctccgggaagtagagatccatttccccagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgaggaaaaatggaaagaaagtaatacaacttagtagaaagacctttgattctgagtatgtcaagactagaaccaatgattgggatttcgtggttacaactgatatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaacgtggaagttgaaatctggacaaaagaaggggaaaggaagaaattgaaacccagatggttggatgctaggatctactctgacccactggcgctaaaagaattcaaagaatttgcagccggaagaaagtctctgactctgaacctaatcacagaaatgggtaggcttccaacattcatgactcagaagacaagagatgcactggacaacctagcagtgctgcacacggctgaagcaggtggaagggcgtacaatcatgctctcagtgaactaccggagaccctagagacactgcttttactgacacttctggctacagtcacaggagggatctttttattcttgatgagtgggaggggcatagggaagatgaccctaggaatgtgctgcataatcacggctagcatccttctatggtacgcacaaatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcttagaaaaaacgaagaaagatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctattattggtagcgcattatgccatcatagggccaggacttcaagcaaaagcaaccagagaagcccagaaaagagcagcggcaggcatcatgaaaaacccaaccgtcgatggaataacagtgattgatctagatccaataccttatgatccaaagtttgaaaagcagttaggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagaaacgcttggagagaaatggaaaagccgattgaacgcactgggaaaaagtgaattccaaatctacaagaaaagtggaatccaggaagtggatagaaccttagcaaaagaaggcatcaaaagaggagaaacggaccatcatgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccaccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaacgcttctgggaacatagtgtcatcagtgaacatgatttcaaggatgttgatcaatagattcacaatgagacacaagaaagctacttacgagccggatgttgacctcggaagcggaacccgtaacattggaattgaaagtgaaataccaaacttagacataattgggaaaagaatagaaaaaataaaggaagagcatgaaacatcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagataataggttttgggagctggttgacaaggaaaggaatctccatcttgaaggaaagtgtgagacatgtgtgtacaacatgatgggaaaaagagaaaagaagctaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttatattctaagagacgtgagcaagaaagagggaggagccatgtacgccgacgacacagcaggatgggacacaagaatcacactagaagacctaaaaaatgaagaaatggtaacaaaccacatggaaggagaacataagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagctgccgtgcaaaactggttggctagagtggggcgcgaaaggttgtcaagaatggccatcagtggagatgattgtgttgtgaaacctttagatgacaggttcgcaaacgctttgacagctctgaatgacatgggaaagattagaaaagacatacaacaatgggaaccttcaaaaggatggaacgattggacacaagtgcccttctgttcacaccatttccatgagctagtcatgaaggatggtcgtgtacttgttgttccatgtagaaatcaagatgaactgattggcagagcccgaatctcccaaggagcagggtggtctttgcgggagacggcctgtttggggaagtcttacgcccaaatgtggagcttaatgtatttccacaggcgtgacctcaggctggcggcaaatgccatttgctcggcagtgccatcacactgggttccaacaagtcgaacaacctggtccatacacgctaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaggcaggagttctgtggtaa

SEQ ID NO: 6543 - RNA, 9876 nt, synthetic construct
  misc_feature 1..9876: note = derived and/or modified CDS sequence (wt) from DENV-2__GQ868625__SS-prME
  source 1..9876: mol_type = other RNA
tctgcaggcatgatcattatgctgattccaacagtgatggcgttccatctaaccacacgcaatggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcggcaatcctggcatacaccatagggacgacacatttccagagagtcctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtgacacctcactcaggggaagagcatgcggtcggaaatgacacaggaaaacacggcatggaaatcaaagtaacaccacagagctccatcacagaagcagaattgacaggttatggcaccgtcacgatggagtgctccccgagaacaggcctcgacttcaatgagatggtgttactgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactctatgtgcacaggaaagtttaaagttgtgaaggaaatagcagaaacacaacatggaacgatagttatcagagtgcaatatgaaggggacggctctccatgcaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttccatcggccgaatgtttgagacaacgatgagaggggcgaagagaatggccattttgggtgacacagcctgggacttcggatccctgggaggagtgtttacatccataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcattacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaagtgaagttaaccatcatgacaggagacatcaaaggaatcatgcaggcaggaaaacgatctctgcggcctcagcccactgagctaaagtattcatggaaaacatggggtaaagcaaaaatgctctccacagagtcttacaaccaaacctttctcattgatggccctgagacagcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgtacattaccacccctaagatacagaggtgaggatgggtgctggtacgggatggaaatcagaccattgaaagagaaagaagaaaatctggttaactccttggtcacagccggacatgggcaggttgacaatttttcactaggagtcttgggaatggcattattcctggaggaaatgcttaggacccgagtaggaacgaaacatgcaatactactagttgcagtttcctttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactacttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgcttactggacgatcggctgacttggaactggagagagcaaccgatgtcaaatgggaagaccaggcagagatatcaggaagcagtccaatcctgtcaataacaatatcagaagacggtagcatgtcgataaaaaacgaagaggaagaacaaacactgaccatactcattagaacaggattgctggtgatctcaggactttttcctatatcaataccaatcacagcagcagcgtggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagctgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcctccgggaagtagagatccatttccccagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgaggaaaaatggaaagaaagtaatacaacttagtagaaagacctttgattctgagtatgtcaagactagaaccaatgattgggatttcgtggttacaactgatatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaacgtggaagttgaaatctggacaaaagaaggggaaaggaagaaattgaaacccagatggttggatgctaggatctactctgacccactggcgctaaaagaattcaaagaatttgcagccggaagaaagtctctgactctgaacctaatcacagaaatgggtaggcttccaacattcatgactcagaagacaagagatgcactggacaacctagcagtgctgcacacggctgaagcaggtggaagggcgtacaatcatgctctcagtgaactaccggagaccctagagacactgcttttactgacacttctggctacagtcacaggagggatctttttattcttgatgagtgggaggggcatagggaagatgaccctaggaatgtgctgcataatcacggctagcatccttctatggtacgcacaaatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcttagaaaaaacgaagaaagatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctattattggtagcgcattatgccatcatagggccaggacttcaagcaaaagcaaccagagaagcccagaaaagagcagcggcaggcatcatgaaaaacccaaccgtcgatggaataacagtgattgatctagatccaataccttatgatccaaagtttgaaaagcagttaggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagaaacgcttggagagaaatggaaaagccgattgaacgcactgggaaaaagtgaattccaaatctacaagaaaagtggaatccaggaagtggatagaaccttagcaaaagaaggcatcaaaagaggagaaacggaccatcatgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaacgcttctgggaacatagtgtcatcagtgaacatgatttcaaggatgttgatcaatagattcacaatgagacacaagaaagctacttacgagccggatgttgacctcggaagcggaacccgtaacattggaattgaaagtgaaataccaaacttagacataattgggaaaagaatagaaaaaataaaggaagagcatgaaacatcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttatattctaagagacgtgagcaagaaagagggaggagccatgtacgccgacgacacagcaggatgggacacaagaatcacactagaagacctaaaaaatgaagaaatggtaacaaaccacatggaaggagaacataagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagctgccgtgcaaaactggttggctagagtggggcgcgaaaggttgtcaagaatggccatcagtggagatgattgtgttgtgaaacctttagatgacaggttcgcaaacgctttgacagctctgaatgacatgggaaagattagaaaagacatacaacaatgggaaccttcaaaaggatggaacgattggacacaagtgcccttctgttcacaccatttccatgagctagtcatgaaggatggtcgtgtacttgttgttccatgtagaaatcaagatgaactgattggcagagcccgaatctcccaaggagcagggtggtctttgcgggagacggcctgtttggggaagtcttacgcccaaatgtggagcttaatgtatttccacaggcgtgacctcaggctggcggcaaatgccatttgctcggcagtgccatcacactgggttccaacaagtcgaacaacctggtccatacacgctaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaggcaggagttctgtggtaa

SEQ ID NO: 6544 - RNA, 9876 nt, synthetic construct
  misc_feature 1..9876: note = derived and/or modified CDS sequence (wt) from DENV-2__KF955401__SS-prME
  source 1..9876: mol_type = other RNA
tctgcaggcatgatcattatgctgattccaacagtaatggcgttccatctaaccacacgcaatggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcggcaatcctggcatacaccatagggacgacacatttccagagagtcctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtgacacctcactcaggggaagagcatgcggtcggaaatgacacaggaaaacacggcatggaaatcaaagtaacaccacagagctccatcacagaagcagaattgacaggttatggcaccgtcacgatggagtgctccccgagaacaggcctcgacttcaatgagatggtgttactgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactctatgtgcacaggaaagtttaaagttgtgaaggaaatagcagaaacacaacatggaacgatagttatcagagtgcaatatgaaggggacggctctccatgcaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatccataggaaaagctctccaccaagtctttggagcaatctatggagttgcctttagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcattacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaaccatcatgacaggagacatcaaaggaatcatgcaggcaggaaagcgatctttgcggcctcagcccactgagctaaagtattcatggaaaacatggggtaaagcaaaaatgctcttcacagagtcttataaccaaacctttctcattgatggccctgagacagcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcacctaggcaagcttgagatggactttgatttctgcgatggaaccacagtgatagtgactgaggactgcggaaatagaggaccctctttgagaacaactactgcctctggaaaactcataacagaatggtgctgccgatcttgtacattaccacccctaagatacagaggtgaggatgggtgctggtacgggatggaaatcagaccattgaaagagaaagaagaaaatctggttaactccttggtcacagccggacatgggcaggttgacaatttttcactaggagtcttgggaatggcattattcctggaggaaatgcttaggacccgagtaggaacgaaacatgcaatactactagttgcagtttcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactacttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgcttactggacgatcggccgacttggaactggagagagcaaccgatgtcaaatgggaagaccaggcagagatatcgggaagcagtccaatcctgtcaataacaatatcagaagatggtagcatgtcgataaaaaacgaagaggaagaacaaacactgaccatactcattagaacaggattgctggtgatctcaggactttttcctatatcaataccaatcacagcagcagcgtggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcctccgggaagtagagatccatttccccagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgaggaaaaatggaaagaaagtaatacaacttagtagaaagacctttgattctgagtatgtcaagactagaaccaatgattgggatttcgtggttacaactgacatttcagagatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaacgtggaagttgaaatctggacaaaagaaggggaaaggaagaaattgaaacccagatggttggatgctaggatctactctgacccactggcgctaaaagaattcaaagaatttgcagccggaagaaagtctctgactctgaacctaatcacagaaatgggtaggcttccaacattcatgactcagaagacaagagatgcactggacaacctagcagtgctgcacacggctgaagcaggtggaagggcgtacaatcatgctctcagtgaactaccggagaccctagagacactgcttttactgacacttctggctacagtcacaggagggatctttttattcttgatgagtgggaggggcatagggaagatgaccctaggaatgtgctgcataatcacggctagcatccttctatggtacgcacaaatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcttagaaaaaacgaagaaagatcttggattaggaagcattgcaacccagcaacccgagagcaacatcctggacatagatctacgtcccgcatcagcttggacgctgtatgccgtggctacaacattcgtcacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctattattggtagcgcattatgccatcatagggccaggacttcaagcaaaagcaaccagagaagcccagaaaagagcagcggcaggcatcatgaaaaacccaaccgtcgatggaataacagtgattgatctagatccaataccttatgatccaaagtttgaaaagcagttaggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagaaacgcttggagagaaatggaaaagccgattgaacgcactgggaaaaagtgaattccaaatctacaagaaaagtggaatccaggaagtggatagaaccttagcaaaagaaggcatcaaaagaggagaaacggaccatcatgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaacgcttctgggaacatagtgtcatcagtgaacatgatttcaaggatgttgatcaatagattcacaatgagacacaagaaagctacttacgagccggatgttgacctcggaagcggaacccgtaacattggaattgaaagtgaaacaccaaacttagacataattgggaaaagaatagaaaaaataaaggaagagcatgaaacatcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatggggaaaagagaaaagaagctaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttatattctaagagacgtgagcaagaaagagggaggagccatgtacgccgacgacacagcaggatgggacacaagaatcacattagaagacctaaaaaatgaagaaatggtaacaaaccacatggaaggagaacataagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggaaggagaaggagtctttaaaaacatccagcacctgacagtcacagaagaagctgccgtgcaaaactggttggctagagtggggcgcgaaaggttgtcaagaatggccatcagtggagatgattgtgttgtgaaacctttagatgacaggttcgcaaacgctttgacagctctgaatgacatgggaaagattagaaaagacatacaacaatgggaaccttcaaaaggatggaacgattggacacaagtgcccttctgttcacaccatttccatgagctaatcatgaaggatggtcgtgtacttgttgttccatgtagaaatcaagatgaactgattggcagagcccgaatctcccaaggagcagggtggtctttgcgggagacggcctgtttggggaagtcttacgcccaaatgtggagcttaatgtatttccacaggcgtgacctcaggctggcggcaaatgccatttgctcggcagtgccatcacactgggttccaacaagtcgaacaacctggtccatacacgctaaacatgaatggatgacaacggaagacatgctgacagtctggaacagggtgtggattcgagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaggcaggagttctgtggtaa

SEQ ID NO: 6545 - RNA, 9876 nt, synthetic construct
  misc_feature 1..9876: note = derived and/or modified CDS sequence (wt) from DENV-2__JF730047__SS-prME
  source 1..9876: mol_type = other RNA
tctgcaggcatgatcattatgctgattccaacagtgatggcgttccatctaaccacacgtaacggagaaccacacatgatcgtcggtatacaggagaaagggaaaagtcttctgttcaaaacagaggatggtgtgaacatgtgcaccctcatggctatggaccttggtgaattgtgtgaagacacaatcacatacaagtgtcctctgctcaggcagaatgagccagaggacatagactgttggtgcaactccacgtccacgtgggtaacctatgggacttgtactaccacgggagaacatagaagagaaaaaagatcagtggcactcgttccacatgtgggaatgggactggagacgcgaaccgaaacatggatgtcgtcagaaggggcttggaaacatgcccagagaattgaaacttggatcctgagacatccaggcttcaccataatggcagcaatcttggcatacaccatagggacgacacatttccagagagccctgattttcattctattgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaatacaacaacagaatcccgttgcccaacacaaggggaacccagcctaaaagaagagcaggataagaggttcgtctgcaaacactccatggtagacaggggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacagggaaacacggcaaggaaatcaaagtaacaccacagagttccatcacagaagctgaattgacaggttatggcaccgtcacgatggaatgctctccgagaacaggcctcgacttcaatgagatggtgttgctgcagatggaaagtaaagcttggctggtgcataggcaatggttcctagacctgccattaccgtggctgcccggagcggacaaacaagggtcaaattggatacagaaagaaacattggtcactttcaaaaatccccatgcaaagaaacaggatgttgttgttttaggatctcaagaaggggccatgcatacagcactcacaggagccacagagatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatacgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacaatgagaggagcaaagagaatggccattttgggtgacacagcctgggactttggctccctaggaggagtgtttacatctataggaaaagctctccaccaagtctttggagcaatctatggagctgccttcagtggggtttcatggactatgaaaatcctcataggagtcattattacatggataggaatgaactcacgcagcacttcactgtctgtgtcactagtattggtgggaattgtgactctgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccccgagacggcagaatgccctaacacaaatagagcttggaactcgttggaggttgaagactacggctttggagtgttcaccaccaatatatggctaaaattgaaagagaaacaggatgcattctgcgactcaaaactcatgtcagcagccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccacacacaaacagcaggaccatggcatctaggcaagcttgagatggactttgatttctgcgatggaaccacagtgatagtgaccgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaattctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcaccaccatgacggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccattcttgaattgactgatgcgttagccttaggcatgatggtcctcaaaatagtaagagacatggaaaagtatcaattagcagtgactattatggctatcttgtgcgtcccaaacgcagtgatattacagaatgcatggaaagtgagttgcacaatactggcagtggtgtccgtttccccactgcttttgacatcttcacagcaaaaaacggattggataccattagcattgacaattaagggcctcaatccaacagccatctttctaacaaccctctcaagaaccaacaagaaaaggagctggccactaaatgaggccatcatggcagtcggaatggtgagcattctagccagttccctcctgaaaaatgacattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcatcagaacaggattgctggtgatctcaggactttttcctgtatcaataccaatcacggcagcagcatggtacctgtgggaagtgaagaaacaacgggccggagtattgtgggacgttccctcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgttcaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccgataagataccaaaccccagctatcagagctgagcacactgggcgggaaattgtggatttaatgtgtcatgccacatttaccatgaggctgctatcaccagttagagtgccaaactacaacttgattatcatggacgaagcccatttcacagacccagcaagtatagcagctagaggatacatctcgacacgagtggagatgggtgaggcagctgggattttcatgacagccactcccccgggaagtagagatccatttcctcagagcaatgcaccaatcatagatgaagaaagagaaatccctgagcgttcatggaatactggacatgagtgggttacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgactgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaacccaaaaaatgaaaatgaccagtacatatacatgggagaacctctggaaaatgatgaagactgtgcacactggaaagaagccaaaatgctcctagacaacattaacacaccagaaggaatcattcccagtatgtttgaaccagagcgtgaaaaagtggatgccattgatggcgaataccgcttgagaggagaagcaaggaaaacctttgtggacttaatgaggagaggagacctaccagtctggttggcttacaaagtggcagctgaaggcatcaactatgcagacagaaggtggtgttttgatggaattaagaacaaccaaatcctggaagaaaatgtggaagttgaaatctggacaaaagaaggagaaaggaagaaattgaaacctagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgctcttactgacacttctggctacagtcacaggagggatctttttattcttgatgagcggaaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcctggacgctgtatgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaatccaactgtcgatggaataacagtgattgatctagatccaataccttatgatccaaagtttgaaaagcagttgggacaggtaatgctactaatcctctgcgtgactcaagtattgatgatgaggactacatgggctctgtgtgaggccttgaccttagctacagggcccatctccacactgtgggaaggaaatccaggaaggttctggaacactaccattgcggtgtcaatggctaacatctttagagggagttacttggctggagctggacttctcttttccattatgaagaacacaactaacacaagaaggggaactggcaacataggagagacgcttggagagaaatggaaaagccgattgaatgcactgggaaaaagtgaattccagacctacaagaaaagtggaatccaagaagtggatagaaccttagcaaaagaaggcatcaagagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaatgtaagagaagtgaaaggcctaacaaaaggaggaccaggacacgaagaacccatccctatgtcaacatatgggtggaatctagtgcgtctccagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcggtgaacatgatttcaaggatgttgatcaacagattcacaatgagacacaagaaagccacttacgagccggatgttgacctcggaagcggaacccgtaacattggaattgaaagtgaaataccaaacctagacataattgggaaaagaatagaaaaaataaaacaagagcacgaaacatcatggcactacgatcaagaccacccatacaaaacgtgggcataccatggtagctatgaaacaaaacagactggatcagcatcatccatggtcaacggagtggtcaggctactaacaaaaccttgggacgtccttcccacggtgacacagatggcaatgacagacacgactccatttggacaacagcgtgtttttaaagaaaaagtggacacgagaacccaagaaccgaaagaaggcacgaagaaattaatgaaaatcacagcagaatggctgtggaaagaattagggaagaaaaagacacctaggatgtgcaccagagaagaattcataagaaaagtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagaaggaggagccatgtacgccgacgacacagcaggatgggacacaagaatcacactagaagacttaaaaaatgaagaaatggtaacaaaccacatggaaggagaacacaaaaaattagccgaggctattttcaaactaacgtatcaaaacaaggtggtgcgtgtgcaaagaccaacaccaagaggcacagtaatggacatcatatcgagaagagaccaaagaggcagtgggcaagttggtacctatggactcaatactttcaccaatatggaagcccaattaatcagacagatggagggagaaggagtctttaaaaacatccagcacctgacagccacagaagaagttgccgtgaaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgcagaaaccaagatgaactgattggcagagcccgaatctcccaaggagcagggtggtctttgcgggagacggcctgtttggggaaatcttacgcccaaatgtggagcttgatgtatttccacaggcgtgacctcaggctggctgcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggctaacaagcagggccacatgggcaaagaacatccaagcagcaataaatcaagttagatctcttataggcaatgaggaatacacagattacatgccatccatgaaaagattcagaagagaagaggaagaagcaggagtcctgtggtaa

SEQ ID NO: 6546 - RNA, 9876 nt, synthetic construct
  misc_feature 1..9876: note = derived and/or modified CDS sequence (wt) from DENV-2__JF730048__SS-prME
  source 1..9876: mol_type = other RNA
tctgcaggcatgatcattatgctgattccaacagtgatggcgttccatctaaccacacgtaacggagaaccacacatgatcgtcggtatacaggagaaagggaaaagtcttctgttcaaaacagaggatggtgtgaacatgtgcaccctcatggctatggaccttggtgaattgtgtgaagacacaatcacatacaagtgtcctctgctcaggcagaatgagccagaggacatagactgttggtgcaactccacgtccacgtgggtaacctatgggacttgtactaccacgggagaacatagaagagaaaaaagatcagtggcactcgttccacatgtgggaatgggactggagacgcgaaccgaaacatggatgtcgtcagaaggggcttggaaacatgcccagagaattgaaacttggatcctgagacatccaggcttcaccataatggcagcaatcttggcatacaccatagggacgacacatttccagagagccctgattttcattctattgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaatacaacaacagaatcccgttgcccaacacaaggggaacccagcctaaaagaagagcaggataagaggttcgtctgcaaacactccatggtagacaggggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacagggaaacacggcaaggaaatcaaagtaacaccacagagttccatcacagaagctgaattgacaggttatggcaccgtcacgatggaatgctctccgagaacaggcctcgacttcaatgagatggtgttgctgcagatggaaagtaaagcttggctggtgcataggcaatggttcctagacctgccactaccgtggctgcccggagcggacaaacaagggtcaaattggatacagaaagaaacattggtcactttcaaaaatccccatgcaaagaaacaggatgttgttgttttaggatctcaagaaggggccatgcatacagcactcacaggagccacagagatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatacgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacaatgagaggagcaaagagaatggccattttgggtgacacagcctgggactttggctccctaggaggagtgtttacatctataggaaaagctctccaccaagtctttggagcaatctatggagctgccttcagtggggtttcatggactatgaaaatcctcataggagtcattattacatggataggaatgaactcacgcagcacttcactgtctgtgtcactagtattggtgggaattgtgactctgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccccgagacggcagaatgccctaacacaaatagagcttggaactcgttggaggttgaagactacggctttggagtgttcaccaccaatatatggctaaaattgaaagagaaacaggatgcattctgcgactcaaaactcatgtcagcagccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccacacacaaacagcaggaccatggcatctaggcaagcttgagatggactttgatttctgcgatggaaccacagtgatagtgaccgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaattctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcaccaccatgacggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccattcttgaattgactgatgcgttagccttaggcatgatggtcctcaaaatagtaagagacatggaaaagtatcaattagcagtgactattatggctatcttgtgcgtcccaaacgcagtgatattacagaatgcatggaaagtgagttgcacaatactggcagtggtgtccgtttccccactgcttttgacatcttcacagcaaaaaacggattggataccattagcattgacaattaagggcctcaatccaacagccatctttctaacaaccctctcaagaaccaacaagaaaaggagctggccactaaatgaggccatcatggcagtcggaatggtgagcattctagccagttccctcctgaaaaatgacattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcatcagaacaggattgctggtgatctcaggactttttcctgtatcaataccaatcacggcagcagcatggtacctgtgggaagtgaagaaacaacgggccggagtattgtgggacgttccctcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgttcaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccgataagataccaaaccccagctatcagagctgagcacactgggcgggaaattgtggatttaatgtgtcatgccacatttaccatgaggctgctatcaccagttagagtgccaaactacaacttgattatcatggacgaagcccatttcacagacccagcaagtatagcagctagaggatacatctcgacacgagtggagatgggtgaggcagctgggattttcatgacagccactcccccgggaagtagagattcatttcctcagagcaatgcaccaatcatagatgaagaaagagaaatccctgagcgttcatggaatactggacatgagtgggttacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgactgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaacccaaaaaatgaaaatgaccagtacatatacatgggagaacctctggaaaatgatgaagactgtgcacactggaaagaagccaaaatgctcctagacaacattaacacaccagaaggaatcattcccagtatgtttgaaccagagcgtgaaaaagtggatgccattgatggcgaataccgcttgagaggagaagcaaggaaaacctttgtggacttaatgaggagaggagacctaccagtctggttggcttacaaagtggcagctgaaggcatcaactatgcagacagaaggtggtgttttgatggaattaagaacaaccaaatcctggaagaaaatgtggaagttgaaatctggacaaaagaaggagaaaggaagaaattgaaacctagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgctcttactgacacttctggctacagtcacaggagggatctttttattcttgatgagcggaaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcctggacgctgtatgccgtggctacaacatttgttacaccaatgctgagacatagcattgagaattcctcagtgaatgtatccctaacagctatagccaaccaagcaacagtgttaatgggtctggggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaatccaactgtcgatggaataacagtgattgatctagatccaataccttatgatccaaagtttgaaaagcagttgggacaggtaatgctactaatcctctgcgtgactcaagtattgatgatgaggactacatgggctctgtgtgaggccttgaccttagctacagggcccatctccacactgtgggaaggaaatccaggaaggttctggaacactaccattgcggtgtcaatggctaacatctttagagggagttacttggctggagctggacttctcttttccattatgaagaacacaactaacacaagaaggggaactggcaacataggagagacgcttggagagaaatggaaaagccgattgaatgcactgggaaaaagtgaattccagacctacaagaaaagtggaatccaagaagtggatagaaccttagcaaaagaaggcatcaagagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaatgtaagagaagtgaaaggcctaacaaaaggaggaccaggacacgaagaacccatccctatgtcaacatatgggtggaatctagtgcgtctccagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcggtgaacatgatttcaaggatgttgatcaacagattcacaatgagacacaagaaagccacttacgagccggatgttgacctcggaagcggaacccgtaacattggaattgaaagtgaaataccaaacctagacataattgggaaaagaatagaaaaaataaaacaagagcacgaaacatcatggcactacgatcaagaccacccatacaaaacgtgggcataccatggtagctatgaaacaaaacagactggatcagcatcatccatggtcaacggagtggtcaggctactaacaaaaccttgggacgtccttcccacggtgacacagatggcaatgacagacacgactccatttggacaacagcgtgtttttaaagaaaaagtggacacgagaacccaagaaccgaaagaaggcacgaagaaattaatgaaaatcacagcagaatggctgtggaaagaattagggaagaaaaagacacctaggatgtgcaccagagaagaattcacaagaaaagtgagaagcaatgcagccttgggggccatattcactgacgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagaaggaggagccatgtacgccgacgacacagcaggatgggacacaagaatcacactagaagacttaaaaaatgaagaaatggtaacaaaccacatggaaggagaacacaaaaaattagccgaggctattttcaaactaacgtatcaaaacaaggtggtgcgtgtgcaaagaccaacaccaagaggcacagtaatggacatcatatcgagaagagaccaaagaggcagtgggcaagttggtacctatggactcaatactttcaccaatatggaagcccaattaatcagacagatggagggagaaggagtttttaaaaacatccagcacctgacagccacagaagaagttgccgtgaaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgcagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggctgcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggctaacaagcagggccacatgggcaaagaacatccaagcagcaataaatcaagttagatctcttataggcaatgaggaatacacagattacatgccatccatgaaaagattcagaagagaagaggaagaagcaggagtcctgtggtaa

SEQ ID NO: 6547 - RNA, 9876 nt, synthetic construct
  misc_feature 1..9876: note = derived and/or modified CDS sequence (wt) from DENV-2__KF955402__SS-prME
  source 1..9876: mol_type = other RNA
tctgcaggcatgatcattatgctgattccaacagtaatggcgttccacctaaccacacgcaatggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcggcaatcctggcatacaccatagggacgacacatttccagagagtcctgattttcatcctactgacagctgtcgctccttcaatgacaatgcgttgcataggaatatcaaatagagtctttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtgacacctcactcaggggaagagcatgcggtcggaaatgacacaggaaaacacggcatggaaatcaaagtaacaccacagagctccatcacagaagcagaattgacaggttatggcaccgtcacgatggagtgctccccgagaacaggcctcgacttcaatgagatggtgttactgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactctatgtgcacaggaaagtttaaagttgtgaaggaaatagcagaaacacaacatggaacgatagttatcagagtgcaatatgaaggggacggctctccatgcaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatccataggaaaagctctccaccaagtctttggagcaatctatggagttgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcattacagacaacgtgcacacatggacagaacaatacaagttccaaccagaatccccttcaaaactagcttcagctatccagaaagctcaagaagagggaatttgtgggatccgttcggtaacaagattggagaacctaatgtggaaacaaataacaccagaattgaatcacattctagcagaaaatgaggtgaagttaaccatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccctgagacagcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcacctaggcaagcttgagatggactttgatttctgcgatggaaccacagtgatagtgactgaggactgcggaaatagaggaccctctttgagaacaactactgcctctggaaaactcataacagaatggtgctgccgatcttgtacattaccacccctaagatacagaggtgaggatgggtgctggtacgggatggaaatcagaccattgaaagagaaagaagaaaatctggttaactccttggtcacagccggacatgggcaggttgacaatttttcactaggagtcttgggaatggcattattcctggaggaaatgcttaggacccgagtaggaacgaaacatgcaatactactagttgcagtttcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtcctcaaaatagtaagaaacatggaaaagtatcaattagcagtgactatcatggctatcttgtgcgtcccaaatgcagtgatattacaaaatgcatggaaagtgagttgcacaatactggcagtggtgtccgtttccccactacttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgcttactggacgatcggccgacttggaactggagagagcaaccgatgtcaaatgggaagaccaggcagagatatcgggaagcagtccaatcctgtcaataacaatatcagaagatggtagcatgtcgataaaaaacgaagaggaagaacaaacactgaccatactcattagaacaggattgctggtgatctcaggactttttcctatatcaataccaatcacagcagcagcgtggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccattttacagacccagcaagtatagcagctagaggatacatctcaacccgagtggagatgggtgaggcagctgggattttcatgacagccactcctccgggaagtagagatccatttccccagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgaggaaaaatggaaagaaagtaatacaacttagtagaaagacctttgattctgagtatgtcaagactagaaccaatgattgggatttcgtggttacaactgacatttcagagatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaacgtggaagttgaaatctggacaaaagaaggggaaaggaagaaattgaaacccagatggttggatgctaggatctactctgacccactggcgctaaaagaattcaaagaatttgcagccggaagaaagtctctgactctgaacctaatcacagaaatgggtaggcttccaacattcatgactcagaagacaagagatgcactggacaacctagcagtgctgcacacggctgaagcaggtggaagggcgtacaatcatgctctcagtgaactaccggagaccctagagacactgcttttactgacacttctggctacagtcacaggagggatctttttattcttgatgagtgggagaggcatagggaagatgaccctaggaatgtgctgcataatcacggctagcatcctcctatggtacgcacaaatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcttagaaaaaacgaagaaagatcttggattaggaagcattgcaacccagcaacccgagagcaacatcctggacatagatctacgtcccgcatcagcttggacgctgtatgccgtggctacaacattcgtcacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctattattggtagcgcattatgccatcatagggccaggacttcaagcaaaagcaaccagagaagcccagaaaagagcagcggcaggcatcatgaaaaacccaaccgtcgatggaataacagtgattgatctagatccaataccttatgatccaaagtttgaaaagcagttaggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcagtgtcaatggctaacatctttagagggagttacttggctggagctggacttctcttttccattatgaagaacacaaccaacacaagaaggggaactggcaacataggagaaacgcttggagagaaatggaaaagccgattgaacgcactgggaaaaagtgaattccaaatctacaagaaaagtggaatccaggaagtggatagaaccttagcaaaagaaggcatcaaaagaggagaaacggaccatcatgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaacgcttctgggaacatagtgtcatcagtgaacatgatttcaaggatgttgatcaatagattcacaatgagacacaagaaagctacttacgagccggatgttgacctcggaagcggaacccgtaacattggaattgaaagtgaaacaccaaacttagacataattgggaaaagaatagaaaaaataaaggaagagcatgaaacatcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatggggaaaagagaaaagaagctaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttatattctaagagacgtgagcaagaaagagggaggagccatgtacgccgacgacacagcaggatgggacacaagaatcacattagaagacctaaaaaatgaagaaatggtaacaaaccacatggaaggagaacataagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagctcaattaatcagacagatggaaggagaaggagtctttaaaaacatccagcacctgacagtcacagaagaagctgccgtgcaaaactggttggctagagtggggcgcgaaaggttgtcaagaatggccatcagtggagatgattgtgttgtgaaacctttagatgacaggttcgcaaacgctttgacagctctgaatgacatgggaaagattagaaaagacatacaacaatgggaaccttcaaaaggatggaacgattggacacaagtgcccttctgttcacaccatttccatgagctaatcatgaaggatggtcgtgtacttgttgttccatgtagaaatcaagatgaactgattggcagagcccgaatctcccaaggagcagggtggtctttgcgggagacggcctgtttggggaagtcttacgcccaaatgtggagcttaatgtatttccacaggcgtgacctcaggctggcggcaaatgccatttgctcggcagtgccatcacactgggttccaacaagtcgaacaacctggtccatacacgctaaacatgaatggatgacaacggaagacatgctgacagtctggaacagggtgtggattcgagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaggcaggagttctgtggtaa

SEQ ID NO: 6548 - RNA, 9876 nt, synthetic construct
  misc_feature 1..9876: note = derived and/or modified CDS sequence (wt) from DENV-2__FJ898460__SS-prME
  source 1..9876: mol_type = other RNA
acagcaggcgtgattgttatgttgattccaacagcgatagcgttccatttaaccacacgcaatggagaaccacacatgatcgttggtaggcaggagaaagggaaaagtctcctgttcaaaacagaggatggtgtcaacatgtgtaccctcatggccatagaccttggtgaattgtgtgaagatacaatcacgtacaagtgtcctctcctcagacaaaatgaaccagaagacatagattgttggtgtaactcaacgtccacatgggtaacttatgggacatgtaccaccacaggagaacacagaagggaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgatgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcatcgtgacctgtgctatgtttacatgcaaaaagaacatggaaggaaaagtcgtacagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggtttctagacctgccgttaccatggctacccggagcggacacacaaggatcaaattggatacagaaagagacattggtcactttcaaaaatccccacgctaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacctccattcggagacagctacatcatcataggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttaatggggtctcatggactatgaaaatcctcataggagtcatcatcacatggataggaatgaattcacgtagcacctcactgtctgtgtcgctagtattggtgggagtcgtgacactgtacctgggagccatggtgcaggctgatagtggttgcgttgtgagctggaaaaataaagaactgaaatgtggtagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagagaatgaagtaaagttgaccattatgacaggagacattaaaggaatcatgcaggcaggaaaacgatccttacggcctcagcccactgagctgaagtactcatggaaaacatggggaaaggcgaaaatgctctctacagagtctcacaatcagacctttcttattgatggccctgaaacagcagaatgccccaacacaaacagagcttggaactcgctggaagttgaagactatggttttggagttttttccaccaatatatggctaaaattgagagaaaaacaggatgtattttgtgactcaaaactcatgtcagcggccattaaagacaacagagccgtccatgccgatatgggctattggatagaaagtgcactcaatgacacatggaagatggagaaagcctccttcattgaagttaaaagctgccactggccaaagtcacacaccctctggagcaatggagtattagaaagtgagatgataattccaaaaagttttgccgggccagtgtcacaacacaactacagaccaggctaccatacacaaacagcaggaccttggcatctaggtaagcttgagatggattttgatttctgcgaaggaactacagtggtggtgactgaggactgtggaaatagaggaccctctttaagaacgaccactgcctctggaaaactcataacagaatggtgttgccgatcctgcacactaccacctctaagatacagaggtgaggacggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccatgccagagaccattcttgaactgactgatgcgttagccttgggcatgatggtcctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcttaacatcctcacagcagaaagcggattggataccattggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtttttccagtatcgataccaattacggcagcagcatggtacctatgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagagggagaatggaaggaaggagaggaagtccaagtcctggcattggaacctggaaaaaatcccagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagactgaccatcatggacctccatccaggagcaggaaagacaaaaagataccttccagccatagttagagaagccataaaacgtggcttgagaacattaatcctggctcccactagagtcgtggcagctgaaatggaggaagctcttagaggactcccaataagataccaaaccccagccatcagagccgagcacaccgggcgggagatcgtggacctaatgtgtcatgccacatttactatgaggctgctatcaccagtcagagtgccaaattacaacctgattatcatggacgaagcccacttcacagacccagcaagcatagcagctagaggatacatctcaactcgagtagagatgggtgaagcagccgggattttcatgacagccactcctccgggaagtagagacccatttccccagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagcaggaagacttttgactctgagtatgttaagactagagccaatgattgggactttgtggtcacaactgatatttcagaaatgggtgccaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctagaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgaggggagaagcaaggaaaacctttgtggacctaatgagaagaggggacttaccagtctggttggcctacaaagtggcagctgaaggcatcaactacgcagacagaaagtggtgttttgatggaatcaagaacaaccaaatactggaagaaaacgtggaagtggaaatctggacaaaagaaggggaaaggaaaaaattaaaacccagatggttggatgctagaatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacagctagcatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagctacagtgctaatgggtcttggaaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgcttctaatcctctgcgtgactcaagtattaatgatgaggacaacatgggctttgtgtgaggctctaaccctagcaaccgggcccatttccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctataagaaaagtggaatccaggaagtggatagaaccctagcaaaagaaggcatcaaaagaggagaaacggaccaccatgctgtgtcacgaggatcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccgtccccatgtcaacatatgggtggaatctagtacgtctgcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagacaccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacagcagagtggctttggaaagaactaggaaagaaaaagacacctaggatgtgtaccagagaagaattcacaaaaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggggaaggaatcttcaaaagcattcagcacctgacagccacagaagaaatcgctgtacagaactggttagcaagagtggggcgtgaaaggctatcaagaatggccatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcctgtttggggaagtcttacgcccaaatgtggaccctgatgtacttccatagacgtgacctcagactggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 6549 - RNA, 9876 nt, synthetic construct
  misc_feature 1..9876: note = derived and/or modified CDS sequence (wt) from DENV-2__FJ882602__SS-prME
  source 1..9876: mol_type = other RNA
actgcaggcatgatcatcatgctgattccaacagcgatggcgttccatttaaccacacgcaatggagaaccacacatgatcgtcagcagacaagagaaagggaaaagtctcttgtttaaaacagaggatggtgtgaacatgtgtaccctcatggccatggaccttggtgaactgtgtgaagacacaatcacctataactgtcctcttctcaggcagaatgaaccagaagatatagattgttggtgcaactccacgtccacatgggtaacttatgggacatgcactgccacaggagaacacagaagggaaaaaagatcagtggcactcgtcccacatgtgggaatgggattggagacacgaactgaaacatggatgtcatcagaaggggcctggaaacacgcccagagaattgaaacctggatcttgagacatccaggttttaccataatggcagcaatcttggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacaacgatggcaaaaaacaaaccaacattggactttgaactgataaaaactgaagccaagcaacctgccactctaaggaagtactgtatagaggcaaagctgaccaacacaacaacagcatctcgctgcccaacacaaggtgaacccagcctaaatgaagagcaggacaaaaggttcgtctgcaaacattccatggtagacagaggatggggaaatggatgtggattatttggaaagggaggcatcgtgacctgtgctatgttcacatgcaaaaaaaacatggaaggaaaaatcgtgcagccagaaaacctggaatacaccattgtgataacacctcactcaggggaagagaatgcagttggaaatgacacaggaaaacatggcaaggaaatcaaagtaacaccacagagttccattacagaagcagaactgacaggctatggcactgtcacgatggagtgctctccgagaacgggcctcgacttcaatgagatggtgttgctgcaaatggaaaacaaagcttggctggtgcacaggcaatggttcttagacctgccgttaccatggttgcccggagcggacacacaaggatcaaattggatacagaaggagacattggtcaccttcaaaaatccccatgcgaaaaaacaggatgttgttgttttaggatcccaagaaggggctatgcatacagcacttacaggggccacggaaatccagatgtcatcaggaaacctactgttcacaggacatctcaagtgcaggctgagaatggacaaactacagctcaaaggaatgtcatactctatgtgcacaggaaagtttaaagtcgtaaaggaaatagcagaaacacaacatggaacaatagttatcagagtacaatacgaaggggatggttctccatgtaaaatcccttttgagataatggatttggaaaaaagacatgtcttaggtcgcctgattacagtcaacccaatagtcacagaaaaagacagcccagtcaacatagaagcagaacctccattcggagacagctacatcattataggagtagaaccaggacaactgaagctcagctggtttaagaaaggaagctcaatcggccaaatgttcgagacaacaatgagaggagcgaagagaatggccattttaggtgacacagcctgggatttcggatccctgggaggagtgttcacatctataggaaaagcccttcaccaagtttttggagcaatctatggggctgccttcagtggggtctcatggactatgaaaatcctcataggagttgttatcacatggataggaatgaattcacgtagcacctcactgtctgtggcattagtattagtgggagtcgtgacattgtatttgggagttatggtgcaggctgatagtggttgtgtagtgagttggaaaaataaagaactgaaatgtggcagtgggatttttatcacagacaatgtacacacatggacagaacaatacaaattccaaccagaatccccctcaaagctggcttcagctatccagaaagctcatgaagagggcatttgtggaatccgctcagtaacaagactggagaatctaatgtggaaacaaataacaccagaactgaatcacattctatcagaaaatgaggtgaagttgactatcatgacaggagacatcaaaggaatcatgcaggcaggaaaacgatccctgaggcctcagcccactgagctgaagtattcatggaaaacatggggcaaagcgaaaatgctctccacagaacctcataaccagacctttctcattgatggccccgaaacagcagaatgtcccaacacaaacagagcttggaactcactagaagttgaagactatggctttggggtgttcaccaccaacatatggctgaagttgaaagaaaggcaggatgtgttttgtgactcaaaactcatgtcagcggccataaaagacaacagagccgtccatgccgacatgggttattggatagaaagcgcacttaatgacacatggaagatagagaaagcctcttttatcgaagttaaaagttgccactggccaaaatcacatactctctggagtaatggagtgctagaaagtgagatgataattccaaagaattttgctggaccagtatcacaacataattacagaccaggttatcacacacaaacggcaggaccctggcatctaggcaagcttgagatggactttgatttttgcgaaggaaccacagtggtggtgactgaggactgtggaaatagaggaccctctctaagaacaactaccgcctctggaaaactcataacagaatggtgttgccgatcctgcacattaccaccgctaagatacagaggtgacgatggatgttggtacggaatggaaatcagaccattgaaagagaaggaagagaacttggtcaactctttggtcacagccggatatggacagattgacaacttctcactaggagtcttgggaatggcattgttcctggaagaaatgctcaggacccgagtaggaacaaaacatgcagtattactagttgcagtttctttcatgacattgatcacagggaacatgtctttccgagacctggggagagtggtggttatggtgggggctgctatgacggatgacataggtatgggcgtgacttatcttgccttgctagcagccttcaaagtcagaccaacttttgcagctggactacttttgagaaagctgacctctaaggaattgatgatgaccaccataggaatcgtactcctctcccagagtaccataccagagactatacttgaactgactgatgcgttggctttgggcatgatgatcctcaaaatagtaagaaatatggaaaagtatcaattagcagtgactatcatggctatcttatgcgttccaaatgcagtgatattacaaaatgcatggaaagtgagctgcacaatactagcagtggtgtccgtttccccactgctcttaacatcttcacagcagaaagcggattggataccattggcattgacgatcaaaggtctcaatccaacagccattttcctaacaaccctttcaagaactaacaagaaaaggagttggccactaaatgaggctatcatggcagtcgggatggtgagcattttagccagttctctcttaaagaatgacattcccatgacaggaccattagtggctggagggcttctcactgtgtgttacgtgctcactggaagatcggctgatttggagctggagagagccgccgacgtaagatgggaagatcaggcagagatatcaggaagtagtccaattctgtcaataacaatatcggaagatggcagcatgtcgataaaaaatgaagaggaagaacaaacactgaccatactcattagaacaggattgctggtgatatcagggctttttcccgtatcaataccaatcacggcagcagcatggtacctgtgggaagtgaagaaacaacgggctggagtattgtgggatgttccttcacccccacctgtgggaaaggccgaactggaagatggagcctatagaatcaagcagaaagggattcttggatactcccagatcggagctggagtttacaaagaaggaacattccacacaatgtggcacgtcacacgtggtgctgttctaatgcataaagggaagagaattgaaccatcatgggcggatgtcaggaaagacctaatatcatatggaggaggctggaagctagaaggagaatggaaggaaggagaagaagtccaggtcttggcattagagcctggaaagaatccaagagccgtccaaacaaaacccggtctttttaaaactaacaccggaaccataggcgctgtatctctagacttttctcctggaacgtcaggatctccaatcgtcgataaaaaaggaaaagtcgtgggtctttatggcaatggtgtcgtcacaagaagtggaacatatgtgagtgccatagcccagactgagaaaagcattgaagacaatccagagattgaagatgacatctttcggaaaagaagattgaccattatggacctccacccaggagcgggaaagacgaaaagataccttccagcaatagtgagagaggccataaaacgaggcttgagaacattaatcctggcccccactagagtcgtggcagctgaaatggaggaagcccttagaggacttccaataagataccaaactccagccatcagagctgagcacactgggcgagaaattgtggatttaatgtgtcatgccacatttaccatgaggctgctatcaccagttagagtgccaaattacaacctgatcattatggatgaagcccatttcacagacccagcaagtatagcagctagaggatacatttcaactcgagtagagatgggtgaagcagctgggattttcatgacagccactcctccgggaagcagagacccatttcctcagagcaatgcaccaatcatggatgaggaaagggaaatccctgaacgttcgtggaattctggacatgagtgggttacggattttaaagggaagactgtttggtttgttccgagtataaaagcaggaaatgatatagcagcttgcctgagaaaaaatggaaagaaagtgatacaactcagtaggaagacctttgactctgaatacatcaagactaggaccaatgattgggactttgtggtcacgactgacatttcagaaatgggtgctaacttcaaggctgaaagggttatagaccccaggcgctgcatgaaaccagtcatactaacagacggtgaagagcgggtgatcctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagctaagatgcttctagacaacatcaacacgcctgaaggaatcattcccagcatgttcgaaccagagcgtgaaaaggtggatgccattgacggtgaataccgcttaagaggagaagcgaggaaaacctttgtggacctaatgagaagaggagacctaccagtctggctggcctacagagtggcagccgaaggcattaactatgcagacagaaggtggtgttttgatggaatcaagaacaaccaaatcttggaagaaaatgtggaagtggaaatctggacaaaagaaggggaaaggaagaaattgaaacccagatggttggatgctaggatctactctgacccgttggcgctcaaagaattcaaagagtttgcagctggaagaaaatccctgaccttgaatttaatcacagaaatgggtaggcttccaacctttatgactcagaaagcaaggaacgcactggacaacttagcagtcctgcatacggctgaagcaggcggaagggcgtacaatcatgctctcagtgaactgccagaaaccctggagacactgctcctgctgacacttttagctacagtcacgggcggaatctttttattcttgatgagcggaaaaggtatagggaaaatgaccctgggaatgtgctgcataatcacggccagtattctcctatggtacgcacaaatacagccacactggatagcagcttcaataatattggagttttttctcatagtcttgctcattccagagccagaaaagcagagaacaccccaagataaccaattaacttacgttgtcatagccatcctcacagtggtggctgcaaccatggcaaacgagatggggttcctggaaaagacgaagaaagatctcggattgggaagcattgcaacccagcaacccgagagcaacatcctggatatagatctacgtcctgcatcagcatggaccctgtatgccgtggccacaacatttatcacaccaatgttgagacatagcattgaaaattcctcagtgaatgtgtctctaacagccattgccaaccaagccacagtgctaatgggtcttgggaaaggatggccattgtcaaaaatggacattggagttccccttctcgccatcgggtgctattcacaagtcaaccccataactctcacagcagcccttcttttattggtagcacattatgccatcatagggccaggactccaagcgaaagcaaccagagaagcgcagaaaagagcagcagcaggcatcatgaaaaacccaactgtggatggaataacagtgattgacctagatccaataccctatgatccaaaatttgagaagcagctgggacaagtaatgctcctagtcctctgcgtgactcaagtactgatgatgaggactacatgggctttgtgtgaggctctaaccttagcgactgggcccatctccacattgtgggaaggaaatccagggagattttggaatacaactattgcagtgtcaatggctaacatttttagaggaagttacttggctggagctggacttctcttttctatcatgaagaacacaaccaacacaagaaggggaactggcaacacaggagagacgcttggagagaaatggaaaaaccgattgaatgcattggggaaaagtgaattccagatctacaagaaaagcggaatccaggaagtggatagaaccttggcaaaagaaggcattaaaagaggagaaacggaccatcacgctgtgtcgcgaggctcagcaaagctgagatggttcgtcgagagaaacctggttacaccagaggggaaagtagtggacctcggttgcggcagagggggctggtcatactattgtgggggcctaaaaaatgtaagagaagtcaaaggcctaacaaaaggaggacctggacacgaagaacccattcccatgtcaacatatgggtggaatctagtgcgtcttcaaagtggagttgatgtcttctttactccgccagaaaagtgtgacacattgttgtgtgacataggggagtcgtcaccaaatcccacggttgaagcaggacgaacactcagagtcctaaacttggtggaaaattggctgaacaacaacacccaattttgcataaaggttcttaacccatacatgccctcagtcatagaaaaaatggaagcgctgcaaaggaaatacggaggagctttggtgaggaacccactttcaagaaattccacacatgagatgtattgggtatccaatgcttccgggaacatagtgtcatcagtgaacatgatttcaaggatgttgatcaatagatttacaatgagacacaagaaggccacatacgaaccagatgttgacctcggaagcggaacccgcaacatcggaattgaaagtgagacaccaaacctagacataattggaaaaagaatagaaaaaataaaacaagagcatgaaacatcatggcattatgaccaagaccacccatataaaacgtgggcctaccatggcagctacgaaacaaaacagactggatcagcatcatccatggtgaatggagtagttagattgctgacaaaaccttgggacgtcattcctatggtgacacagatggcaatgacagacacgaccccatttggacaacagcgtgttttcaaagagaaagtggacacgagaacccaagaaccaaaagaaggcacgaagaaactaatgaaaatcacggctgaatggctctggaaagaactaggaaagaaaaagacacctaggatgtgcactagagaagaattcacaagaaaggtgagaagcaatgcagccctaggtgccatattcactgatgagaacaagtggaagtcggcacgtgaggctgttgaagacagcagattttgggaactggttgacaaagaaaggaatctccatcttgaaggaaagtgtgagacatgtgtgtacaacatgatgggaaagagagagaagaagctaggggaattcggcaaagcaaaaggcagcagagccatatggtacatgtggcttggagcacgcttcttagagtttgaagccctaggattcttgaatgaggatcactggttttcccgagaaaactctctgagtggagtggaaggagaagggctgcacaagctgggttacattctaagagatgtgagcaaaaaagaaggaggagcaatgtacgccgatgacactgcaggatgggacacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccgacaccaagaggcacagtaatggatattatatcgagaagagaccaaagaggtagtggacaagttggcacctatggcctcaacactttcaccaatatgggagcccaactaatcagacagatggagggagaagaagtcttcaaaggcatccagcacctgacagccacagaagaaattgcagtgcaaaactggttagcaagagtggggcgtgagaggttatcaagaatggccatcagtggagatgattgtgttgtgaaacccttggatgacaggtttgcaagcgctttaacagctctaaatgacatgggaaaggttaggaaagacatacaacaatgggaaccttcaagaggatggaacgattggacacaagtgcctttctgttcacatcatttccatgaattaatcatgaaagacggtcgtgtactcgtagttccatgtagaaaccaagatgaactgatcggtagagcccgaatttcccagggagccgggtggtctttgcgggagacggcctgtctagggaagtcctacgcccaaatgtggagcctgatgtacttccacagacgtgacctcaggctggcggcaaacgctatttgctcggcagttccatcacattgggttccaacaagtcgaacaacctggtccatacacgccagacacgaatggatgacaacagaagacatgctgacagtctggaacagggtgtggattcaagaaaatccatggatggaagacaaaactccagtggaatcatgggaggaaatcccatacttggggaaaagagaagaccaatggtgcggctcattgatagggctaacaagcagggctacctgggcaaagaacatccaaacagcaataaaccaagtcagatccttaataggcaatgaggaatacacagactatatgccatccatgaaaagattcagaagagaagaggaagaggcaggggtcttgtggtag

SEQ ID NO: 6550 - RNA, 9876 nt, synthetic construct
  misc_feature 1..9876: note = derived and/or modified CDS sequence (wt) from DENV-2__GQ252676__SS-prME
  source 1..9876: mol_type = other RNA
actgcaggcgtgatcatcatgctgattccaacagcgatggcgttccatttaaccacacgcaacggagaaccacacatgatcgtcagcaaacaagagaaagggaaaagtctcttgtttaaaacagaggaaggtgtgaacatgtgcaccctcatggccatggaccttggtgaactgtgtgaagacacaatcacttataactgtcctcttctcaggcagaatgaaccagaagatatagattgttggtgtaactccacgtccacatgggtaacttatgggacatgcactgccacaggagaacacagaagggaaaaaagatcagtggcactcgtcccacatgtgggaatgggattggagacacgaactgaaacatggatgtcatcagaaggggcctggaaacacgcccagagaattgaaacctggatcttgagacatccaggttttaccataatggcagcaatcttggcatacaccataggaacgacatatttccaaagagtcctgatcttcatcttactgacagctgtcgctccttcaatgacaatgcgttgtattggaatatcaaatagagactttgtggaaggggtttcaggaggaagctgggttgacatagtcttagaacatggaagctgtgtgacaacgatggcaaaaaacaaaccaacattggactttgaactgataaaaacagaagccaagcaacctgccactctaaggaagtactgtatagaggcaaagctgaccaacacaacaacagcatctcgatgcccaacacaaggggaacccagcctaaatgaagaacaggacaaaaggtttgtctgcaaacattccatggtagacagaggatggggaaatggatgtggattatttggaaagggaggcattgtgacctgtgctatgttcacatgcaaaaaaaacatggaagggaaaattgtgcaaccagaaaacctggaatacaccattgtggtaacacctcattcaggggaagagaatgcagttggaaatgacacaggaaaacatggcaaggaaatcaaagtaacaccacagagttccattacagaagcagaactgacaggctacggcactgtcacgatggagtgctctccaagaacgggcctcgacttcaatgagatggtgttgctgcaaatggaaaataaggcttggctggtgcacaggcaatggttcttagacctgccattaccatggttgcccggagcggacatacaaggatcaaattggatacagaaggagacgttggtcaccttcaaaaatccccatgcgaagaaacaggatgttgttgttttaggatcccaagaaggggctatgcatacagcacttacaggggccacggaaatccagatgtcatcaggaaacctactgttcacaggacatctcaagtgcaggctgagaatggataaattacagctcaaaggaatgtcatactctatgtgtacaggaaagtttaaagttgtaaaggaaatagcagaaacacaacatggaacaatagttgttagagtacaatatgaaggggatggctctccatgtaaaatcccttttgagataatggatttggaaaaaagacatgtcttaggtcgcctgattacagtcaacccaatcgtcacagaaaaagacagtccagtcaacatagaagcagaacccccattcggagacagctacatcattataggagtagaaccgggacaactgaagctcagctggtttaagaaaggaagctcaatcggccaaatgttcgagacaacaatgagaggagcgaagagaatggccattttaggtgatacagcctgggattttggatccctgggaggagtgttcacatctataggaaaggccctccaccaagtttttggagcaatctatggggctgccttcagtggggtttcatggactatgaaaatcctcataggagttgtcatcacatggataggaatgaattcacgtagcacctcactgtctgtgtcactagtattagtgggagtcgtgacattgtatttgggagttatggtgcaggctgatagtggttgtgttgtgagttggaaaaacaaagaactgaaatgtggcagtgggattttcatcacagacaatgtacacacatggacagaacaatacaaattccaaccagaatccccctcaaagctggcttcagctatccagaaagctcatgaagaaggcatttgtggaatccgctcagtaacaagactggagaatctaatgtggaaacaaataacaccagaactgaatcacattctatcagaaaatgaggtaaagttgtctatcatgacaggagacatcaaaggaatcatgcaggcaggaaaacgatccctgcggcctcagcccactgagctgaagtattcatggaaaacgtggggcaaagcgaaaatgctctccacagagcctcataaccagacctttctcattgatggccccgaaacagcagaatgtcccaacacaaacagagcttggaactcactagaagttgaagactatggctttggggtattcaccaccaacatatggctgaagttgaaagaaaggcaggatgtgttttgtgactcaaaactcatgtcagcggccataaaagacaacagagccgtccatgccgatatgggttattggatagaaagcgcacttaatgacacatggaagatagaaaaagcttcttttatcgaagttaaaagttgccactggccaaaatcacacactctctggagtaacggagtgctagaaagtgagatgataattccaaagaattttgctggaccagtatcacaacataattacagaccaggctatcacacacaaacggcaggaccttggcatctaggcaagcttgagatggactttgatttttgcgaaggaaccacagtggtggtgactgaggactgtggaaatagaggaccctctctaagaacaactactgcttctggaaaactcataacagaatggtgctgccgatcctgcacattaccaccactaagatacagaggcgaggatggatgctggtacggaatggaaatcagaccattgaaagagaaagaagagaacttggtcaattctttggtcacagccggacatggacagattgacaacttctcactaggagtcttgggaatggcactgttcctggaagaaatgctcaggacccgagtaggaacaaaacatgcagtattactagttgcagtttctttcatgacattgatcacagggaacatgtctttccgagacctggggagagtgatggttatggtgggggccgctatgacggatgacataggtatgggcgtgacttatcttgccttactagcagccttcaaagttagaccaacttttgcagctggactgcttttgagaaagctgacctccaaggaattgatgatgaccaccataggaatcgtactcctctcccagagcaccataccagagactatacttgaactgactgatgcgttggccttgggcatgatgattctcaagatagtgagaaatatggaaaagtatcaattggcagtgactatcatggctatcttatgtgttccaaatgcagtgatattacaaaatgcatggaaagtgagctgcacaatactggcagcggtgtccgtatccccactgctcttaacatcttcgcagcagaaagcggattggataccattggcattgacgatcaaaggtctcaatccaacagccattttcctaacaaccctttcaagaactaacaagaaaaggagttggccactaaatgaggctatcatggcagtcgggatggtgagcattttagctagttctctcttgaagaatgacattcccatgacaggaccattagtggctggagggcttctcaccgtgtgttacgtgctcactggaagatcggccgacctggaactagagagagccgccgacgttagatgggaagatcaggcagagatatcaggaagcagtccaattctgtcaataacaatatcggaagatggcagcatgtcgataaaaaatgaagaggaagaacaaacactgaccatactcattagaacaggattgctggtgatatcaggacttttccccgtatcaataccaatcacggcagcagcatggtacctgtgggaagtgaagaaacaacgggctggagtattgtgggatgttccttcacccccacctgtgggaaaggccgaactggaggatggagcttacagaatcaagcagaaagggattcttggatactcccagatcggagctggagtttacaaagaaggaacattccacacaatgtggcacgtcacacgtggtgctgttctaatgcataaagggaagaggattgaaccatcatgggcggatgtcaggaaagacctaatatcgtatggaggaggctggaagctagaaggagaatggaaggaaggagaagaagtccaggtcttggcattagagcctggaaagaatccaagagccgtccaaacaaaacccggtctttttaaaactaacaccggaaccataggcgctgtgtctctagacttttctcctggaacgtcaggatctccaatcgtcgacaaaaaaggaaaagtcgtgggtctctatggcaatggtgtcgtcacaaggagtggaacatatgtgagtgccatagcccagactgaaaaaagcattgaagacaatccagagattgaagatgatatctttcgaaaaaaaagattgaccattatggacctccacccaggagcgggaaagacgaaaagataccttccagcaatagttagagaggccataaaacgaggcttaagaacattaatcctggcccccactagagtcgtggcagctgaaatggaagaagctcttagaggacttccaataagataccaaaccccagccatcagagctgagcacactgggcgagaaatcgtggatttaatgtgtcatgccacatttaccatgaggctgttatcaccagttagagtgccaaattacaacttgatcattatggatgaagcccatttcacagacccagcaagcatagcagctagaggatacatttcaactcgagtagagatgggtgaagcagctgggattttcatgacagccactcctccgggaagcagagacccatttcctcaaagcaatgcaccaatcatggatgaagaaagggaaatccctgaacgttcgtggaactctggacatgagtgggttacagatttcaaagggaagactgtttggtttgttccgagtataaaagcaggtaatgatatagcagcttgcctgagaaaaaatggaaagaaagtgatacaactcagtaggaagacctttgattctgaatacatcaagactaggaccaatgattgggactttgtggtcacgactgacatttcagaaatgggtgctaacttcaaggctgaaagggttatagaccccaggcgctgcatgaaaccagtcatactaacagacggtgaagagcgggtgatcctggcaggacccatgccagtgacccactctagtgcagcacaaagaagagggagaataggaagaaatccaaaaaatgaaaatgaccagtacatatacatgggggaacctctggaaaatgatgaagactgcgcacactggaaagaagccaagatgcttttagacaacatcaacacgcctgaaggaatcattcccagcatgttcgaaccagagcgtgaaaaggtggatgctattgatggtgaataccgcttaagaggagaagcgaggaaaacctttgtggacctaatgagaagaggagacctaccagtctggctggcctacagagtggcagccgaaggcattaactatgcagacagaaggtggtgttttgatggaatcaagaacaaccaaatcttggaagaaaatgtggaagtggaaatctggacaaaagaaggggaaaggaagaaactgaaacccagatggttggatgctaggatctactctgacccactggcgctcaaagaattcaaagagtttgcagctggaagaaaatccctgaccctgaatttaatcacagaaatgggtaggcttccaacttttatgactcagaaagcaaggaacgcactggacaacttagcagtcctgcatacggctgaagcaggcggaagggcgtacaatcatgctctcagtgaactgccagagaccctggagacattgcttttgctgacacttttggccacagtcacgggcggaatctttttattcttgatgagtggcaaaggtatagggaaaatgaccctgggaatgtgctgcataatcacggccagtattctcctatggtacgcacaaatacagccacactggatagcagcttcaataatactggagttttttctcatagtcttgctcattccagagccagaaaagcaaagaacaccccaagataaccaattgacttacgttgtcatagccatcctcacagtggtggccgcaaccatggcaaatgagatggggttcctggaaaaaacgaagaaagatttcggattgggaagcattgcaacccagcaacccgagagcaacatcctggacatagatctacgtcctgcatcagcatggaccctgtatgcagtggccacaacatttatcacaccaatgttgagacatagcattgaaaattcctcagtgaacgtgtctctaacagccattgctaatcaggccacagtgctaatgggtcttgggaaaggatggccattgtcaaaaatggacattggagttccccttctcgccatcgggtgctattcacaagtcaaccccataaccctcacagcagcccttcttttattggtagcacattacgctatcatagggccaggactccaagcgaaagcaaccagagaagcgcagaaaagagcagcagcaggcatcatgaaaaacccaactgtggatggaataacagtgattgacctagatccaataccctatgatccaaaatttgagaagcagctgggacaagtaatgctcctagtcctctgcgtgactcaagtactgatgatgaggactacatgggctttgtgtgaggctctaaccttagcgaccgggcccatctccacattgtgggaaggaaatccagggagattctggaatacaaccattgcagtgtcaatggctaacatttttagaggaagttacctagctggagctggacttctcttttccatcatgaagaacacaaccaacacaagaaggggaactggcaacacaggagagacgcttggagagaaatggaaaaaccgattgaattcattggggaagagtgaattccagatttacaagagaagcggaattcaggaagtggatagaaccttggcaaaagaaggcattaaaagaggagaaacggaccatcatgctgtgtcgcgaggctcagcaaagctgagatggttcgtcgagagaaacctggttacaccagaggggaaagtagtggacctcggttgcggtagagggggctggtcatactattgtgggggtctaaagaatgtaagagaagtcaaaggcctaacaaaaggaggaccaggacacgaagaacccattcccatgtcaacatatgggtggaatcttgtgcgtctccaaagtggagttgatgttttctttactccaccagaaaaatgtgacacattgttgtgtgatataggggagtcgtcaccaaatcccacggttgaagctggacgaacactcagagtcctaaacttggtagaaaattggctgaacaacaacacccaattttgcataaaggttcttaacccatacatgccctcagtcatagaaaaaatggaaacgctgcaaaggaaatacggaggagctttggtgaggaatcctctctcaagaaattccacacatgagatgtattgggtatccaatgcttccgggaacatagtgtcatcagtgaacatgatttcaaggatgttgatcaatagatttacaatgagacataagaaggccacatacgagccagatgttgacctcggaagcggaacccgcaacatcggaattgaaagtgagacaccaaacctagacataattgggaaaagaatagaaaaaataaaacaagagcatgagacatcatggcactatgaccaagaccacccatataaaacgtgggcctaccatggcagctacgaaacaaaacagactggatcagcatcatccatggtgaatggagtagttagactgctgacaaaaccttgggacgtcatccctatggtgacacagatggcaatgacagacacgaccccatttggacaacagcgtgttttcaaagagaaagtggacacgagaacccaagaaccgaaagaaggcacgaagaaactaatgaaaatcacggccgaatggctctggaaagaactaggaaagaaaaagacacctagaatgtgcactagagaagaattcgcaagaaaggtgagaagcaatgcagccctaggtgccatattcactgatgagaacaagtggaagtcggcacgtgaggctgttgaagacagtagattttgggaactagttgacaaggaaaggaatctccatcttgaaggaaagtgtgagacatgtgtgtacaacatgatgggaaagagagagaagaagataggggaattcggcaaagcaaaaggcagcagagccatatggtacatgtggcttggagcacgcttcttagagtttgaagccctaggatttctgaatgaagatcactggttttccagagagaactctctgagcggagtggaaggagaagggctgcacaagctgggttacattctaagagaagtgagcaagaaagaaggaggagcaatgtacgccgacgacacagcaggatgggatacaagaatcacactagaggacctaaaaaatgaagagatggtaacaaaccatatggaaggagaacacaagaaacttgctgaggccattttcaaattaacgtaccaaaacaaggtggtgcgtgtgcaaagacccacaccaagaggcacagtaatggatattatatcgagaagagaccaaagaggtagtggacaagttggcacctatggcctcaacacctttaccaatatgggagcccaactaatcagacagatggagggagagggagtctttaaaggcatccagcatctgacagccacagaagaagttgcagtgcaagactggttagcaagagtggggcgtgagaggttatcaagaatggccatcagtggagatgattgtgttgtgaaacccttagatgacaggtttgcaagcgctttaacagctctaaatgacatgggaaaggttaggaaagacatacaacaatgggaaccttcaagaggatggaacgactggacacaagtgcctttctgttcacaccatttccatgagttaatcatgaaagacggtcgtgtgctcgtagttccatgtagaaaccaagatgaactgattggtagagctcgaatttcccagggagccgggtggtctttgcgggagacggcctgtctggggaagtcttacgcccaaatgtggagcctgatgtacttccacagacgtgacctcaggctggcagcaaacgctatttgctcggcagttccatcacattgggttccaacaagtcgaacaacctggtccatacacgccagacatgaatggatgacaacagaagacatgctgacagtctggaacagggtgtggattcaagaaaacccatggatggaagacaaaactccagtggaatcatgggaggaaatcccatacttggggaaaagagaagaccaatggtgcggctcattgatagggttaacaagcagggccacctgggcaaagaacatccaaacagcaataaaccaagttagatccttaataggcagtgaggaatacacagactacatgccatccatgaaaagattcagaagagaagaggaagaggcaggggtcttgtggtag

SEQ ID NO: 6551 - RNA, 9876 nt, synthetic construct
  misc_feature 1..9876: note = derived and/or modified CDS sequence (wt) from DENV-2__GQ252677__SS-prME
  source 1..9876: mol_type = other RNA
actgcaggcgtgatcatcatgctgattccaacagcgatggcgttccatttaaccacacgcaacggagaaccacacatgatcgtcagcaaacaagagaaagggaaaagtctcttgtttaaaacagaggaaggtgtgaacatgtgcaccctcatggccatggaccttggtgaactgtgtgaagacacaatcacttataactgtcctcttctcaggcagaatgaaccagaagatatagattgttggtgtaactccacgtccacatgggtaacttatgggacatgcactgccacaggagaacacagaagggaaaaaagatcagtggcactcgtcccacatgtgggaatgggattggagacacgaactgaaacatggatgtcatcagaaggggcctggaaacacgcccagagaattgaaacctggatcttgagacatccaggttttaccataatggcagcaatcttggcatacaccataggaacgacatatttccaaagagtcctgatcttcatcttactgacagctgtcgctccttcaatgacaatgcgttgtattggaatatcaaatagagactttgtggaaggggtttcaggaggaagctgggttgacatagtcctagaacatggaagctgtgtgacaacgatggcaaaaaacaaaccaacattggactttgaactgataaaaacagaagccaagcaacctgccactctaaggaagtactgtatagaggcaaagctgaccaacacaacaacagcatctcgatgcccaacacaaggggaacccagcctaaatgaagaacaggacaaaaggtttgtctgcaaacattccatggtagacagaggatggggaaatggatgtggattatttggaaagggaggcattgtgacctgtgctatgttcacatgcaaaaaaaacatggaagggaaaattgtgcaaccagaaaacctggaatacaccattgtggtaacacctcattcaggggaagagaatgcagttggaaatgacacaggaaaacatggcaaggaaatcaaagtaacaccacagagttccattacagaagcagaactgacaggctacggcactgtcacgatggagtgctctccaagaacgggcctcgacttcaatgagatggtgttgctgcaaatggaaaataaggcttggctggtgcacaggcaatggttcttagacctgccgttaccatggttgcccggagcggacatacaaggatcaaattggatacagaaggagacgttggtcaccttcaaaaatccccatgcgaagaaacaggatgttgttgttttaggatcccaagaaggggctatgcatacagcacttacaggggccacggaaatccagatgtcatcaggaaacctactgttcacaggacatctcaagtgcaggctgagaatggataaattacagctcaaaggaatgtcatactctatgtgtacaggaaagtttaaagttgtaaaggaaatagcagaaacacaacatggaacaatagttgttagagtacaatatgaaggggatggctctccatgtaaaatcccttttgagataatggatttggaaaaaagacatgtcttaggtcgcctgattacagtcaacccaatcgtcacagaaaaagacagtccagtcaacatagaagcagaacccccattcggagacagctacatcattataggagtagaaccgggacaactgaagctcagctggtttaagaaaggaagctcaatcggccaaatgttcgagacaacaatgagaggagcgaagagaatggccattttaggtgatacagcctgggattttggatccctgggaggagtgttcacatctataggaaaggccctccaccaagtttttggagcaatctatggggctgccttcagtggggtttcatggactatgaaaatcctcataggagttgtcatcacatggataggaatgaattcacgtagcacctcactgtctgtgtcactagtattagtgggagtcgtgacattgtatttgggagttatggtgcaggctgatagtggttgtgttgtgagttggaaaaacaaagaactgaaatgtggcagtgggattttcatcacagacaatgtacacacatggacagaacaatacaaattccaaccagaatccccctcaaagctggcttcagctatccagaaagctcatgaagaaggcatttgtggaatccgctcagtaacaagactggagaatctaatgtggaaacaaataacaccagaactgaatcacattctatcagaaaatgaggtaaagttgtctatcatgacaggagacatcaaaggaatcatgcaggcaggaaaacgatccctgcggcctcagcccactgagctgaagtattcatggaaaacgtggggcaaagcgaaaatgctctccacagagcctcataaccagacctttctcattgatggccccgaaacagcagaatgtcccaacacaaacagagcttggaactcactagaagttgaagactatggctttggggtattcaccaccaacatatggctgaagttgaaagaaaggcaggatgtgttttgtgactcaaaactcatgtcagcggccataaaagacaacagagccgtccatgccgatatgggttattggatagaaagcgcacttaatgacacatggaagatagaaaaagcttcttttatcgaagttaaaagttgccactggccaaaatcacacactctctggagtaacggagtgctagaaagtgagatgataattccaaagaattttgctggaccagtatcacaacataattacagaccaggctatcacacacaaacggcaggaccttggcatctaggcaagcttgagatggactttgatttttgcgaaggaaccacagtggtggtgactgaggactgtggaaatagaggaccctctctaagaacaactactgcttctggaaaactcataacagaatggtgctgccgatcctgcacattaccaccactaagatacagaggcgaggatggatgctggtacggaatggaaatcagaccattgaaagagaaagaagagaacttggtcaattctttggtcacagccggacatggacagattgacaacttctcactaggagtcttgggaatggcactgttcctggaagaaatgctcaggacccgagtaggaacaaaacatgcagtattactagttgcagtttctttcatgacattgatcacagggaacatgtctttccgagacctggggagagtgatggttatggtgggggccgctatgacggatgacataggtatgggcgtgacttatcttgccttactagcagccttcaaagttagaccaacttttgcagctggactgcttttgagaaagctgacctccaaggaattgatgatgaccaccataggaatcgtactcctctcccagagcaccataccagagactatacttgaactgactgatgcgttggccttgggcatgatgattctcaagatagtgagaaatatggaaaagtatcaattggcagtgactatcatggctatcttatgtgttccaaatgcagtgatattacaaaatgcatggaaagtgagctgcacaatactggcagcggtgtccgtatccccactgctcttaacatcttcgcagcagaaagcggattggataccattggcattgacgatcaaaggtctcaatccaacagccattttcctaacaaccctttcaagaactaacaagaaaaggagttggccactaaatgaggctatcatggcagtcgggatggtgagcattttggctagttctctcttgaagaatgacattcccatgacaggaccattagtggctggagggcttctcactgtgtgttacgtgctcactggaagatcggccgacctggaactagagagagccgccgacgttagatgggaagatcaggcagagatatcaggaagcagtccaattctgtcaataacaatatcggaagatggcagcatgtcgataaaaaatgaagaggaagaacaaacactgaccatactcattagaacaggattgctggtgatatcaggacttttccccgtatcaataccaatcacggcagcagcatggtacctgtgggaagtgaagaaacaacgggctggagtattgtgggatgttccttcacccccacctgtgggaaaggccgaactggaagatggagcttacagaatcaagcagaaagggattcttggatactcccagatcggagctggagtttacaaagaaggaacattccacacaatgtggcacgtcacacgtggtgctgttctaatgcataaagggaagaggattgaaccatcatgggcggatgtcaggaaagacctaatatcgtatggaggaggctggaagctagaaggagaatggaaggaaggagaagaagtccaggtcttggcattagagcctggaaagaatccaagagccgtccaaacaaaacccggtctttttaaaactaacaccggaaccataggcgctgtgtctctagacttttctcctggaacgtcaggatctccaatcgtcgacaaaaaaggaaaagtcgtgggtctctatggcaatggtgtcgtcacaaggagtggaacatatgtgagtgccatagcccagactgaaaaaagcattgaagacaatccagagattgaagatgatatctttcgaaaaaaaagattgaccattatggacctccacccaggagcgggaaagacgaaaagataccttccagcaatagttagagaggccataaaacgaggcttaagaacattaatcctggcccccactagagtcgtggcagctgaaatggaagaagctcttagaggacttccaataagataccaaaccccagccatcagagctgagcacactgggcgagaaatcgtggatttaatgtgtcatgccacatttaccatgaggctgttatcaccagttagagtgccaaattacaacttgatcattatggatgaagcccatttcacagacccagcaagcatagcagctagaggatacatttcaactcgagtagagatgggtgaagcagctgggattttcatgacagccactcctccgggaagcagagacccatttcctcaaagcaatgcaccaatcatggatgaagaaagggaaatccctgaacgttcgtggaactctggacatgagtgggttacagatttcaaagggaagactgtttggtttgttccgagtataaaagcaggtaatgatatagcagcttgcctgagaaaaaatggaaagaaagtgatacaactcagtaggaagacctttgattctgaatacatcaagactaggaccaatgattgggactttgtggtcacgactgacatttcagaaatgggtgctaacttcaaggctgaaagggttatagaccccaggcgctgcatgaaaccagtcatactaacagacggtgaagagcgggtgatcctggcaggacccatgccagtgacccactctagtgcagcacaaagaagagggagaataggaagaaatccaaaaaatgaaaacgaccagtacatatacatgggggaacctctggaaaatgatgaagactgcgcacactggaaagaagccaagatgcttttagacaacatcaacacgcctgaaggaatcattcccagcatgttcgaaccagagcgtgaaaaggtggatgctattgatggtgaataccgcttaagaggagaagcgaggaaaacctttgtggacctaatgagaagaggagacctaccagtctggctggcctacagagtggcagccgaaggcattaactatgcagacagaaggtggtgttttgatggaatcaagaacaaccaaatcttggaagaaaatgtggaagtggaaatctggacaaaagaaggggaaaggaagaaactgaaacccagatggttggatgctaggatctactctgacccactggcgctcaaagaattcaaagagtttgcagctggaagaaaatccctgaccctgaatttaatcacagaaatgggtaggcttccaacttttatgactcagaaagcaaggaacgcactggacaacttagcagtcctgcatacggctgaagcaggcggaagggcgtacaatcatgctctcagtgaactgccagagaccctggagacattgcttttgctgacacttttggccacagtcacgggcggaatctttttattcttgatgagtggcaaaggtatagggaaaatgaccctgggaatgtgctgcataatcacggccagtattctcctatggtacgcacaaatacagccacactggatagcagcttcaataatactggagttttttctcatagtcttgctcattccagagccagaaaagcaaagaacaccccaagataaccaattgacttacgttgtcatagccatcctcacagtggtggccgcaaccatggcaaatgagatggggttcctggaaaaaacgaagaaagatttcggattgggaagcattgcaacccagcaacccgagagcaacatcctggacatagatctacgtcctgcatcagcatggaccctgtatgcagtggccacaacatttatcacaccaatgttgagacatagcattgaaaattcctcagtgaacgtgtctctaacagccattgctaatcaagccacagtgctaatgggtcttgggaaaggatggccattgtcaaaaatggacattggagttccccttctcgccatcgggtgctattcacaagtcaaccccataaccctcacagcagcccttcttttattggtagcacattacgctatcatagggccaggactccaagcgaaagcaaccagagaagcgcagaaaagagcagcagcaggcatcatgaaaaacccaaccgtggatggaataacagtgattgacctagatccaataccctatgatccaaaatttgagaagcagctgggacaagtaatgctcctagtcctctgcgtgactcaagtactgatgatgaggactacatgggctttgtgtgaggctctaaccttagcgaccgggcccatctccacattgtgggaaggaaatccagggagattctggaatacaaccattgcagtgtcaatggctaacatttttagaggaagttacctagctggagctggacttctcttttccatcatgaagaacacaaccaacacaagaaggggaactggcaacacaggagagacgcttggagagaaatggaaaaaccgattgaattcattggggaagagtgaattccagatttacaagagaagcggaattcaggaagtggatagaaccttggcaaaagaaggcattaaaagaggagaaacggaccatcatgctgtgtcgcgaggctcagcaaagctgagatggttcgtcgagagaaacctggttacaccagaggggaaagtagtggacctcggttgcggtagagggggctggtcatactattgtgggggtctaaagaatgtaagagaagtcaaaggcctaacaaaaggaggaccaggacacgaagaacccattcccatgtcaacatatgggtggaatcttgtgcgtctccaaagtggagttgatgttttctttactccaccagaaaaatgtgacacattgttgtgtgatataggggagtcgtcaccaaatcccacggttgaagctggacgaacactcagagtcctaaacttggtagaaaattggctgaacaacaacacccaattttgcataaaggttcttaacccatacatgccctcagtcatagaaaaaatggaaacgctgcaaaggaaatacggaggagctttggtgaggaatcctctctcaagaaattccacacatgagatgtattgggtatccaatgcttccgggaacatagtgtcatcagtgaacatgatttcaaggatgttgatcaatagatttacaatgagacataagaaggccacatacgagccagatgttgacctcggaagcggaacccgcaacatcggaattgaaagtgagacaccaaacctagacataattgggaaaagaatagaaaaaataaaacaagagcatgagacatcatggcactatgaccaagaccacccatataaaacgtgggcctaccatggcagctacgaaacaaaacagactggatcagcatcatccatggtgaatggagtagttagactgctgacaaaaccttgggacgtcatccctatggtgacacagatggcaatgacagacacgaccccatttggacaacagcgtgttttcaaagagaaagtggacacgagaacccaagaaccgaaagaaggcacgaagaaactaatgaaaatcacggccgaatggctctggaaagaactaagaaagaaaaagacacctagaatgtgcactagagaagaattcgcaagaaaggtgagaagcaatgcagccctaggtgccatattcactgatgagaacaagtggaagtcggcacgtgaggctgttgaagacagtagattttgggaactagttgacaaggaaaggaatctccatcttgaaggaaagtgtgagacatgtgtgtacaacatgatgggaaagagagagaagaagataggggaattcggcaaagcaaaaggcagcagagccatatggtacatgtggcttggagcacgcttcttagagtttgaagccctaggatttctgaatgaagatcactggttttccagagagaactctctgagcggagtggaaggagaagggctgcacaagctgggttacattctaagagaagtgagcaagaaagaaggaggagcaatgtacgccgacgacacagcaggatgggatacaagaatcacactagaggacctaaaaaatgaagagatggtaacaaaccatatggaaggagaacacaagaaacttgctgaggccattttcaaattaacgtaccaaaacaaggtggtgcgtgtgcaaagacccacaccaagaggcacagtaatggatattatatcgagaagagaccaaagaggtagtggacaagttggcacctatggcctcaacacctttaccaatatgggagcccaactaatcagacagatggagggagagggagtctttaaaggcatccagcatctgacagccacagaagaagttgcagtgcaagactggttagcaagagtggggcgtgagaggttatcaagaatggccatcagtggagatgattgtgttgtgaaacccttagatgacaggtttgcaagcgctttaacagctctaaatgacatgggaaaggttaggaaagacatacaacaatgggaaccttcaagaggatggaacgactggacacaagtgcctttctgttcacaccatttccatgagttaatcatgaaagacggtcgtgtgctcgtagttccatgtagaaaccaagatgaactgattggtagagctcgaatttcccagggagccgggtggtctttgcgggagacggcctgtctggggaagtcttacgcccaaatgtggagcctgatgtacttccacagacgtgacctcaggctggcagcaaacgctatttgctcggcagttccatcacattgggttccaacaagtcgaacaacctggtccatacacgccagacatgaatggatgacaacagaagacatgctgacagtctggaacagggtgtggattcaagaaaacccatggatggaagacaaaactccagtggaatcatgggaggaaatcccatacttggggaaaagagaagaccaatggtgcggctcattgatagggttaacaagcagggccacctgggcaaagaacatccaaacagcaataaaccaagttagatccttaataggcagtgaggaatacacagactacatgccatccatgaaaagattcagaagagaagaggaagaggcaggggtcttgtggtag

SEQ ID NO: 6552 - RNA, 9876 nt, synthetic construct
  misc_feature 1..9876: note = derived and/or modified CDS sequence (wt) from DENV-2__FJ898438__SS-prME
  source 1..9876: mol_type = other RNA
acagtaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgttccaccacaggagaacatagaagagaaaaaagatcagtggcgctcgttccacatgtgggtatgggactggagacacgaactgaaacatggatgtcatcagaaggggcctggaaacatgttcagagaattgaaacctggatcttgagacacccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacattccatggtagacagaggatggggaaatggatgtggattatttggaaagggaggcattgtgacctgtgctatgtttacatgcaaaaagaacatggaaggaaaagtcgtgcagccagaaaattttgaatacaccatcgtgataacacctcactcaggagaagagcatgctgtgggtaatgacacaggaaagcatggcaaggaaatcaaaataacaccacagagttccatcacagaagcagaactgacaggctatggcactgtcacgatggagtgctctccgagaacgggcctcgactttaatgagatggtgctgctgcagatggaagacaaagcttggctggtgcacaggcaatggttcctagacctgccgttaccatggctacccggagcggacacacaaggatcaaattggatacaaaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgtttgattacagtcaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatccataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaactcaaacagagcttggaactcgctggaagttgaagactatggttttggagttttcaccaccaatatatggctgaaattgagagaaaaacaggatgtattttgtgactcaaaactcatgtcagcggccattaaggacaacagagccgttcatgccgatatgggttattggatagaaagtgcactcaatgacacatggaagatggagaaagcctcctttattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatttttgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacaaaacatgcaatactgctagttgcagcatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttctccactgctcttaacatcctcacagcagaaagcggattggataccactggcattgacgataaaaggtctcaatccaacagccatttttttaacaactctttcgagaaccagcaagaaaaggagctggccgctgaatgaagctgtcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcggccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaatacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaataaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttttactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctatgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaactcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagtttggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgacacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgcttgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcttgtggtag

SEQ ID NO: 6553 - RNA, 9876 nt, synthetic construct
  misc_feature 1..9876: note = derived and/or modified CDS sequence (wt) from DENV-2__GQ199893__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactccacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgtccagagaattgaaacctggatcttgagacatccaggctttaccataatggcagcaatcctggcatacaccataggaacgacacatttccaaaaggccttgattttcatcctactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacactggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgtcgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaacaaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcagccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgataacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatcgcactcctttcccaaagcaccataccagagaccattcttgaactgactgatgcattagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctatcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagatcggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgccatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaattcctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatagaagtggaaatctggacaaaagaaggggaaaggaaaaaattaaaacccagatggttggatgctaggatctattctgacccactggcactaaaagaattcaaggaatttgcagctggaagaaaatctctgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccattctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaagtctacaagaaaagtggaatccaggaagtggatagaaccctagcaaaagaaggtatcaaaagaggagaaacggaccaccatgctgtgtcgcgaggttcagctaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtttgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagatcacccatacaaaacgtgggcttaccacggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacgccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggggatgattgtgttgtaaaacctatagatgatagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgccacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6554 - RNA, 9876 nt, synthetic construct
  misc_feature 1..9876: note = derived and/or modified CDS sequence (wt) from DENV-2__GQ199894__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgcgaagatacaatcacgtacaagtgtcctctcctcagacaaaatgaaccagaagacatagattgttggtgcaactccacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgtccagagaattgaaacctggatcttgagacatccaggctttaccataatggcagcaatcctggcatacaccataggaacgacacatttccaaaaggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacactggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgtcgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaactgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaacaaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtcccacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcagccattaaagacaatagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaacattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgataacttttcactaggagtcttgggaatggcactgttcctggaagaaatgctcaggacccgaataggaacgaaacatgcaatactgctagttgcagcatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatcgcactcctttcccaaagcaccataccagagaccattcttgaactgactgatgcattagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttctaacaactctttcgagaaccagcaagaaaaggagctggccgctaaatgaagccatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctatcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattcccagatcggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctgggaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgccatagcccagaccgaaaaaagcattgaagacaacccagagatcgaagatgacattttccgaaagaaaagattgaccatcatggacctccatccaggagcaggaaagacaaaaagataccttccagccatagttagagaagccataaaacgtggtttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaattcctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgagggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaatcaagaacaaccaaatactggaagaaaatatagaagtggaaatctggacaaaagaaggggaaaggaaaaaattaaaacccagatggttggatgctaggatctattctgacccactggcactaaaagaattcaaggaatttgcagctggaagaaaatctctgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccattctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctacgatccaaaatttgaaaagcagttaggacaagtaatgctcctaatcctctgcgtgactcaagtattaatgatgaggactacatgggctttgtgtgaggctctaaccttagcgaccgggcccatctccacactgtgggaaggaaatccagggaggttttggaacactaccattgcagtgtcaatggctaacatctttagggggagctacttggccggagccggacttctcttttccatcatgaaaaacacaacaaacacaagaagaggaactggcaacataggagagacacttggagaaaaatggaaaagtcgattaaacgcactgggaaaaagtgaatttcaagtctacaagaaaagtggaatccaggaagtggatagaaccctagcaaaagaaggtatcaaaagaggagaaacggaccaccatgctgtgtcgcgaggttcagctaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtttgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagatcacccatacaaaacgtgggcttaccacggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgtttttaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctatattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacgccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggggatgattgtgttgtaaaacctatagatgatagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgccacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacctgggaaaaagagaagaccaatggtgcggctcattgattgggctaacaagcagggctacctgggcaaagaatatccaaacagcaataaatcaagtcagatcccttataggcaatgaggaatacacagactacatgccatccatgaagagattcagaagggaagaggaagaggcaggtgtcctgtggtag

SEQ ID NO: 6555 - RNA, 9876 nt, synthetic construct
  misc_feature 1..9876: note = derived and/or modified CDS sequence (wt) from DENV-2__FJ898439__SS-prME
  source 1..9876: mol_type = other RNA
acagcaggtgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgttccaccacaggagaacatagaagagaaaaaagatcagtggcgctcgttccacatgtgggtatgggactggagacgcgaactgaaacatggatgtcatcagaaggggcctggaaacatgttcagagaattgaaacctggatcttgagacacccaggctttaccataatggcagcaatcctggcatacaccataggaacgacacatttccaaagggctttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggactttgaactaataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggtaatgacacaggaaaacatggcaaggaaatcaaaataacaccacagagttctatcacagaagcagaactgacaggctatggcactgtcacgatggagtgctctccgagaacgggcctcgacttcaatgagatggtgctgctgcagatggaagacaaagcttggctggtgcataggcaatggttcctagacctgccgttaccatggctacccggagcggacacacaaggatcaaattggatacagaaagagacattggtcactttcaaaaatccccacgcgaagaaacaggatgtcgttgttttagggtctcaggaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacaggaaaagatagcccagtcaacatagaagcagaacctccattcggagacagctacatcatcataggagtagagccgggacaattgaaactcaattggtttaagaagggaagctccatcggccaaatgtttgagacaacaatgagaggagcaaagagaatggccattttaggtgacacagcctgggactttggatccctgggaggagtgtttacatccataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccctaacacaaatagagcttggaactcgctggaagttgaagactatggttttggagttttcaccaccaatatatggctgaaattgagagaaaaacaggatgtattttgtgattcaaaactcatgtcagcggctattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcaggttgacaacttttcactaggagtcttgggaatggcactgttcctggaagaaatgctcaggacccgaataggaacgaaacatgcaatactgctagttgcagcatcttttgtaacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaagaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttctccactgctcttaacatcctcacaacagaaagcggattggataccactggcattgacgataaaaggtctcaatccaacagccatttttctaacaactctttcgagaaccagcaagaagaggagctggccgctaaatgaagctgtcatggcagtcgggatggtgagcattttagccagttctctcctaaagaatgacattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagttttgtgggacgtcccttcacccccaccagtggaaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagtcgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacattcactatgaggctgctatcaccagtcagagtgccaaattacaacctgatcatcatggatgaagcccacttcacagacccagcaagtatagcagctagaggatacatttcaactcgagtagagatgggtgaagcagccggaattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgacatagcagcttgtcttaggaaaaatggaaagaaagtgatacaacttagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaatcaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggctcccaactttcatgactcagaaagcaagaaacgcactggacaacttggctgtgctgcatacggctgagacaggtggaaaggcgtacaatcatgctctcagtgaactgccggagaccctggagacactgcttctactgacactcctggcaacagtcacaggaggaatcttcttattcttaatgagcggaaaaggcatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattcggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattgtagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaactctagcaaaggaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaaaaatgtaagagaagtcaaaggcctaacaaaaggaggaccaggacatgaagaacccatccccatgtcaacatatgggtggaatctagtgcgtctgcaaagtggagttgacgtctttttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacttacgagcctgatgttgacctaggaagtggaacccgcaacattgggattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgttgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagagaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggttaggctacattttaagagacgtgggaaagaaggaagggggagcaatgtacgccgatgacacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaagtcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagtcagaaaagacatacaacaatgggaaccttcaagaggatggaacgattggacacaagtgcctttctgttcacaccattttcatgagttagtcatgaaagatggtcgcgtgctcgtagtcccatgcagaaaccaagatgaactgattggcagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagtagggctacctgggcaaagaacatccaaacagcgataaatcaagtcagatcccttataggcaatgaggaatacacagactacatgccatccatgaagagattcagaagggaagaggaagaggcaggtgtcttgtggtag

SEQ ID NO: 6556 - RNA, 9876 nt, synthetic construct
  misc_feature 1..9876: note = derived and/or modified CDS sequence (wt) from DENV-2__GQ868588__SS-prME
  source 1..9876: mol_type = other RNA
actgcaggcatgatcatcatgctgattccaacagtgatggcatttcatctgaccacacgcaacggagaaccacacatgatcgtcagtagacaagaaaaagggaaaagccttctgtttaagacaaaggatggcacgaatatgtgtactctcatggccttggaccttggtgagttgtgtgaagacacaatcacgtataaatgtccttttctcaagcagaacgaaccagaagacatagattgttggtgcaactccacgtccacatgggtaacttacgggacatgtaccaccacaggagagcacagaagagaaaaaagatcagtggcgcttgttccacacgtgggaatgggattggagacacgaactgaaacatggatgtcatcagaaggggcctggaaacatgcccagagaattgaaacttggattctgagacatccaggctttaccataatggccgcaatcctggcatacaccataggaacgacgcatttccaaagagtcctgatattcatcctactgacagccatcgccccttcaatggcaatgcgctgcataggaatatcaaatagggactttgtggaaggagtgtcaggagggagttgggttgacatagttttagagcatggaagttgtgtgacgacgatggcaaaaaataaaccaacactggactttgaactgataaaaacagaagccaaacaacccgccaccttaaggaagtactgtatagaggctaaactgaccaacacgacaacagactcgcgctgcccaacacaaggggaacccaccctgaatgaagagcaggacaaaaggtttgtctgcaaacattccatggtagacagaggatggggaaatggatgtggattgtttggaaaaggaggcatcgtgacctgtgctatgttcacatgcaaaaagaacatggaaggaaaaattgtgcagccagaaaacctggaatacactgtcgtgataacacctcattcaggggaagaacatgcagtcggaaatgacacaggaaaacatggtaaagaagtcaagataacaccacagagctccatcacagaggcggaactgacaggctatggcactgttacgatggagtgctctccaagaacgggcctcgacttcaatgagatggtgttgctgcaaatggaagacaaagcttggctggtgcacagacaatggttcctagacctaccgttgccatggctgcccggagcagacacacaaggatcaaattggatacagaaagagacattggtcaccttcaagaatccccatgcgaaaaaacaggatgttgttgtcttaggatcccaagaaggggccatgcatacagcactcacaggggctacggaaatccagatgtcatcaggaaacctgctgttcacaggacatcttaaatgcaggctgagaatggacaaattacaacttaaagggatgtcatactccatgtgcacaggaaagtttaaaattgtgaaggaaatagcagaaacacaacatggaacaatagtcattagagtacaatatgaaggagacggctctccatgcaagatcccctttgagataatggatctggaaaaaagacatgttttgggccgcctgatcacagtcaacccaattgtgacagaaaaggacagtccagtcaacatagaagcagaacctccattcggagacagctacatcatcataggagtggaaccaggacaattgaagctggactggttcaggaaaggaagttccatcggccaaatgtttgagacaacaatgaggggagcgaaaagaatggccatcttgggcgacacagcctgggattttggatctctgggaggagtgttcacatcaataggaaaagctctccaccaggtttttggagcaatctacggggctgctttcagtggggtctcatggactatgaagatccttataggagttatcatcacatggataggaatgaactcacgcagcacatcactgtctgtgtcactggtattagtgggaatcgtgacactgtacttgggagttatggttcaagccgatagtggttgcgttgtgagctggaagaacaaagaactaaaatgtggcagtggaatattcgtcacagataacgtgcatacatggacagaacaatacaagttccagccagaatccccttcaaaactggcttcagccatccagaaagctcacgaagaaggcatctgtggaatccgctcagtaacaagactggaaaatcttatgtggaaacagataacatcagaattgaatcatattctatcagaaaatgaagtgaaactgaccatcatgacaggagacatcaaaggaatcatgcaggtaggaaaacgatctctgcggcctcaacccactgagttgaggtattcatggaaaacatggggtaaagcgaaaatgctctccacagaactccacaatcagactttcctcattgatggtcccgaaacagcggaatgccccaacacaaacagagcttggaattcactagaagttgaggactatggctttggagtattcactactaatatatggctaagactgagagaaaagcaggatgtattttgtgactcaaaactcatgtcagcggccataaaggacaacagagccgtccatgctgatatgggttactggatagaaagcgcactcaatgatacatggaagatagagaaagcttctttcattgaagtcaaaagttgccactggccaaagtcacacactctatggagtaatggagtgctagaaagcgagatggtaattccaaagaatttcgctggaccagtgtcacaacataataacagaccaggctatcacacacaaacagcaggaccttggcatctaggcaagcttgagatggactttgatttctgcgaagggaccacagtggtggtaaccgaggaatgtggaaacagagggccttctttaagaacaaccactgcctcaggaaaactcataacggaatggtgttgccgatcttgcacactaccaccactaagatacagaggtgaggatggatgctggtacgggatggaaatcagaccattgaaagagaaagaagaaaatctggtcagttctctggtcacagccggacatgggcagatcgacaatttctcattaggaattctgggaatggcactgttccttgaagaaatgctcaggactcgagtaggaacgaaacatgcaatactactagtcgcagtttctttcgtaacgttaatcacagggaacatgtcttttagagacctgggaagagtgatggttatggtgggtgccaccatgacagatgacataggcatgggtgtgacttatcttgctctactagcagccttcaaagtcagaccaacctttgcagctggactgctcttgagaaaactgacctccaaggaattaatgatgaccaccataggaatcgttcttctctctcagagtagcataccagagaccattcttgagctgaccgatgcgttagctttaggcatgatggtcctcaagatggtgagaaacatggaaaaatatcagctggcagtgactatcatggctattttgtgtgtcccaaatgctgtgatattacagaacgcatggaaagtgagttgcacaatactggcagtggtgtctgtctcccccctgctcttgacatcctcacaacagaaagcggactggataccattagcgttgacgatcaaaggcctcaatccaacagccatttttctaacaaccctctcaagaactagcaagaaaaggagctggcctttaaacgaggccatcatggcggttgggatggtgagtatcttggccagctctctcttgaagaacgacatccccatgacaggaccattagtggctggagggcttcttactgtgtgctacgtattaactgggcggtcagccgatctggaactggagagagctaccgatgtcaaatgggatgaccaggcagagatatcaggtagcagtccaattctgtcaataacaatatcagaagatggcagcatgtcgataaagaatgaagaggaagagcaaacactgactatactcattagaacaggattgcttgtgatctcaggactctttccggtatcaataccaattacagcagcagcatggtacctgtgggaagtaaagaaacaacgggctggagtgttgtgggatatcccctcaccaccacccgtgggaaaggctgaattggaagatggagcctacagaatcaagcaaaaaggaatcctgggatattcccagatcggagctggagtttacaaagaaggaacatttcacaccatgtggcacgtcacacgtggcgctgtcctaatgcataaggggaagaggatcgaaccgtcatgggcggacgtcaagaaagacttaatatcatatggaggaggttggaagctagaaggagaatggaaagaaggagaagaagtccaggtcttggcattggagcctgggaaaaatccaagagccgtccaaacaaaacctggcctttttagaaccaatactggaaccataggtgccgtatccctggacttttcccccgggacgtcaggatctccaatcgttgacaaaaaaggaaaagttgtaggcctctatggcaatggtgtcgttacaaggagtggagcatatgtgagtgccatagctcagactgaaaaaagcattgaagacaatccagaaattgaagatgacatctttcgaaagagaagattgactatcatggatctccacccaggagcaggaaagacaaagaaatacctcccggccatagtcagagaggccataaaaagaggcttgagaacactaatcctagcccccactagagtcgtggcagctgaaatggaggaagcccttagaggacttccaataagataccaaactccagccatcagggctgagcacaccgggcgggagatcgtggacttaatgtgtcatgccacatttaccatgaggctgctatcaccaatcagagtgccaaattacaacctgatcatcatggacgaagcccattttacagatccagcaagcatagcagctaggggatacatctcaactcgagtggagatgggtgaggcagctggaatttttatgacagccactcctccgggtagcagagatccatttcctcagagtaatgcaccaattatggacgaagaaagagaaattccggaacgttcatggaactccgggcacgagtgggtcacggattttaaaggaaagactgtctggtttgttccaagcataaaaaccggaaatgacatagcagcctgcctgagaaagaatggaaagagggtgatacaactcagtaggaagacctttgattctgaatacgtcaagactagaaccaatgactgggatttcgtggttacaactgacatttcggaaatgggtgctaactttaaagctgagagggttatagaccccagacgctgcatgaaaccagttatactgacagacggcgaagagcgggtgattctggcaggacccatgccagtgacccactccagtgcagcacaaagaagagggagaataggaaggaatccaaggaatgaaaatgatcaatacatatatatgggagaacccctggaaaatgatgaagactgtgcgcactggaaggaagctaagatgctcctagataacatcaacacacctgaaggaatcattcccagcatgttcgagccagagcgtgaaaaggtggatgccattgacggtgaatatcgcttgagaggagaagcacggaaaacttttgtggacctaatgagaagaggagacctaccagtctggttggcttataaagtggcatctgaaggtatcaactacgcagacagaagatggtgttttgacggaaccagaaacaatcaaatcttggaagaaaatgtggaagtggaaatttggacaaaggaaggggaaaggaaaaaattgaaacctagatggttagatgctaggatctactccgacccactggcgctaaaagaattcaaggaattcgcagccggaagaaagtccctaaccctgaacctaatcacagagatgggcagactcccaacttttatgactcagaaggccagagatgcactagacaacttggcggtgctgcacacggctgaagcgggtggaaaggcatacaatcatgctctcagtgaactaccggagaccctggagacattgcttttgctgacactgttggccacagtcacgggaggaatctttctattcctgatgagcggaaggggtatagggaagatgaccctgggaatgtgctgcataatcacggccagcatcctcttatggtatgcgcaaatacaaccacattggatagcagcttcaataatattggagttctttctcatagtcttgctcattccagaaccagaaaagcagaggacaccccaggataaccaattgacttatgtcatcatagccatcctcacagtggtggccgcaaccatggcaaacgaaatgggttttctagaaaaaacaaagaaagacctcggactgggacacattgcaactcagcaacctgagagcaacattctggatatagatctacgtcctgcatcagcatggacgttgtatgccgtggctacaacatttatcacaccaatgttgagacatagcattgaaaattcctcagtaaatgtgtccctaacagccatagctaaccaagccacagtgctaatgggtctcgggaaaggatggccattgtcaaagatggacattggagtccccctccttgccattgggtgttactcacaagtcaaccctataaccctcacagcggctcttcttttattggtagcacattatgccatcattggaccgggacttcaagccaaagcaaccagagaagcccagaaaagagcagcagcgggcatcatgaaaaacccaactgtggatggaataacagtgatagatctagatccaataccctatgatccaaagtttgaaaagcagttgggacaagtaatgctcctagtcctttgtgtgacccaagtgctgatgatgaggactacgtgggctttgtgtgaagccttaactctagcaaccggacccgtgtctacattgtgggaaggaaatccagggagattctggaacacaaccattgcagtgtcaatggcaaacatctttagagggagttaccttgctggagctggacttctcttttctatcatgaagaacacaactagcacgagaagaggaactggcaacataggagaaacgctaggagagaaatggaaaagcagactgaacgcattggggaaaagtgaattccagatctacaaaaaaagtggaattcaagaagtggacagaaccttagcaaaagaaggcatcaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattgaagaatgtaagagaagttaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggctgaacaataacactcaattttgcgtaaaggttcttaacccgtacatgccctcagtcattgaaagaatggaaaccttacaacggaaatacggaggagccttggtgagaaatccactctcacggaattccacacatgaaatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaacattggaattgaaagtgagacaccgaacctagacataattgggaaaagaatagaaaaaataaaacaagagcatgaagcgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcccttcggacaacagcgcgtcttcaaagagaaggtggatacgagaacccaagaaccaaaagaaggcacaaaaaaactaatgaaaatcacggcagagtggctctggaaagaactaggaaagaaaaagacacccagaatgtgcaccagagaagaattcacaaaaaaggtgagaagcaatgcagccttgggggccatatttaccgatgagaacaagtggaagtcggcgcgtgaggctgttgaagataataggttttgggagctggttgacaaggaaagaaacctccatcttgaaggaaaatgtgaaacatgtatatacaacatgatgggaaaaagagagaaaaaactaggagagtttggtaaagcaaaaggcagcagagctatatggtacatgtggcttggagcacgcttcttagagtttgaagccctaggatttttgaatgaagaccattggttctctagagagaactccctgagtggagtggaaggagaagggctgcataaactaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtaccaaaacaaggtggtgcgtgtgcaaagaccaacaccaagaggcacggtaatggacatcatatcgagaagagaccaaaggggtagtggacaagttggcacctatggcctcaacactttcaccaacatggaagcacaactaattaggcaaatggagggggaaggaatcttcaaaagcatccagcacttgacagcctcagaagaaatcgctgtgcaagattggctagtaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtgcccttctgttcacaccattttcacgaattaatcatgaaagatggtcgcatactcgtagtcccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaactagccggacaacctggtccatacacgccagccatgaatggatgacgacggaagacatgttgacagtttggaatagagtgtggatcctagaaaatccatggatggaagacaaaactccagtggaatcatgggaagaaatcccatacctgggaaaaagagaagaccaatggtgcggctcgctgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtggtag

SEQ ID NO: 6557 - RNA, 9876 nt, synthetic construct
  misc_feature 1..9876: note = derived and/or modified CDS sequence (wt) from DENV-2__GQ868590__SS-prME
  source 1..9876: mol_type = other RNA
actgcaggcatgatcatcatgctgattccaacagtgatggcgtttcatctgaccacacgcaacggagaaccacacatgatcgtcagtagacaagaaaaagggaaaagccttctgtttaagacaaaggatggcacgaacatgtgtactctcatggccatggaccttggtgagttgtgtgaagacacaatcacgtataaatgtccttttctcaagcagaacgaaccagaagacatagattgttggtgcaactccacgtccacatgggtaacttacggaacatgtaccaccacaggagagcacagaagagaaaaaagatcagtggcgcttgttccacacgtgggaatgggattggaaacacgaactgaaacatggatgtcatcagaaggggcctggaaacatgcccagagaattgaaacttggattctgagacatccaggctttaccataatggccgcaatcctggcatacaccataggaacgacgcatttccaaagagtcctgatattcatcctactgacagccatcgctccttcaatgacaatgcgctgcataggaatatcaaatagggactttgtggaaggagtgtcaggagggagttgggttgacatagttttagaacatggaagttgtgtgacgacgatggcaaaaaataaaccaacactggactttgaactgataaaaacagaagccaaacaacccgccaccttaaggaagtactgtatagaggctaaactgaccaacacgacaacagactcgcgctgcccaacacaaggggaacccaccctgaatgaagagcaggacaaaaggtttgtctgcaaacattctatggtagacagaggatggggaaatggatgtggattgtttggaaaaggaggcatcgtgacctgtgctatgttcacatgcaaaaagaacatggaagggaaaattgtgcagccagaaaacctggaatacactgtcgtgataacacctcattcaggggaagaacatgcagtcggaaatgacacaggaaaacatggtaaagaagtcaagataacaccacagagctccatcacagaggcggaactgacaggctatggcactgttacgatggagtgctctccaagaacgggcctcgacttcaatgagatggtgttgctgcaaatggaagacaaagcttggctggtgcacagacaatggttcctagacctaccgttgccatggctgcccggagcagacacacaaggatcaaattggatacagaaagagacattggtcaccttcaaaaatccccatgcgaaaaaacaggatgttgttgtcttaggatcccaagaaggggccatgcacacagcactcacaggggccacggaaatccaaatgtcatcaggaaacctgctgttcacaggacatctcaaatgcaggctgagaatggacaaattacaacttaaagggatgtcatactccatgtgcacaggaaagtttaaaattgtgaaggaaatagcagaaacacaacatggaacaatagtcattagagtacaatatgagggagacggctctccatgcaagatcccctttgagataatggatctggaaaaaagacatgttttgggccgcctgatcacagtcaacccaattgtaacagaaaaggacagtccagtcaacatagaagcagaacctccattcggagacagctacatcatcataggagtggaaccaggacaattgaagctagactggttcaagaaaggaagttccatcggccaaatgtttgagacaacaatgaggggagcgaaaagaatggccatcttgggcgacacagcctgggattttggatctctgggaggaatgttcacatcaataggaaaagctctccaccaggtttttggagcaatctacggggctgctttcagtggggtctcatggacaatgaagatccttataggagtaattatcacatggataggaatgaactcacgtagcacatcactgtctgtgtcactggtattagtgggaatcgtgacactgtacttgggagttatggtgcaagccgatagtggttgcgttgtgagctggaagaacaaagaattaaaatgtggcagtggaatattcgtcacagataacgtgcacacatggacagaacaatacaagtttcaaccagaatccccttcaaaactggcttcagccatccagaaagctcacgaagaaggcatctgtggaatccgctcagtaacaagactggaaaatcttatgtggaaacagataacaccagaattgaatcatattctatcagaaaatgaagtgaaactgaccatcatgacaggagacaccaaaggaatcatgcaggtaggaaaacgatctctgcggcctcaacccactgagttgagatattcatggaaaacatggggtaaagcgaaaatgctccccacagaactccataatcagaccttcctcattgatggtcctgaaacagcagaatgccccaacacaaacagagcttggaattcactagaagttgaggactatggctttggagtattcactaccaacatatggctaagattgagagaaaagcaggatgtattttgtgactcaaaactcatgtcagcggccataaaggataacagagccgtccatgctgatatgggttattggatagaaagcgcactcaatgatacatggaagatagagaaagcttctttcattgaagtcaaaagttgccactggccaaagtcacacactctatggagtaatggagtgctagaaagcgagatggtaattccaaagaatctcgctggaccagtgtcacaacataataacagaccaggctatcacacacaaacagcaggaccttggcatctaggcaagcttgagatggactttaatttctgcgaagggaccacagtggtggtaaccgaggaatgtggaaacagagggccttctttaagaacaaccactgcctcaggaaaactcataacggaatggtgttgtcgatcttgcacactaccaccactaagatacagaggtgaggatggatgctggtacgggatggaaatcagaccattgaaagagaaagaagaaaatctggtcagttctctggtcacagccggacatgggcagattgacaatttctcattaggaattttgggaatggcactgttccttgaagaaatgctcaggactcgagtaggaacgaaacatgcaatactactagtcgcagtttctttcgtaacgttaatcacagggaacatgtcttttagagacctgggaagagtgatggttatggtgggtgccactatgacagatgacataggcatgggtgtaacttatcttgctctactagcagcctacaaagtcagaccaacctttgcagctggattactcttgagaaaactgacctccaaggaattaatgatgaccaccataggaatcgttcttctctctcagagtagcataccagagaccattcttgagctgaccgatgcgttagctttaggcatgatggtcctcaagatggtgagaaacatggaaaaatatcagctggcagtgactatcatggctattttgtgtgtcccaaatgctgtgatattacagaacgcatggaaagtgagttgcacaatactggcagtggtgtctgtttcccccctgctcttgacatcctcacaacagaaagcggactggataccattagcgttgacgatcaaaggcctcaatccaacagccatttttctaacaaccctctcaagaactagcaagaaaaggagctggcctttaaacgaggccatcatggcggttgggatggtgagtatcttggccagctctctcttgaagaacgacatccccatgacaggaccattagtggctggagggcttcttactgtgtgctacgtgttgactgggcggtcagccgatctggaactagagaaagctaccgatgtcaaatgggatgaccaggcagagatatcaggtagcagtccaattctgtcaataacaatatcagaagatggcagcatgtcgataaagaatgaagaggaagagcaaacactgactatactcattagaacaggattgcttgtgatctcaggactctttccggtatcaataccaattacagcagcagcatggtacctgtgggaagtaaagaaacagcgggctggagtgttgtgggatgtcccctcaccaccacccgtgggaaaggctgaattggaagatggagcctacagaatcaagcaaaaaggaatcctaggatattcccagatcggagctggagtttacaaagagggaacatttcacaccatgtggcacgtcacacgtggcgctgtcctaatgcataaggggaagaggattgaaccgtcatgggcggacgtcaagaaagacttaatatcatatggaggaggttggaagctagaaggagaatggaaagaaggagaagaagtccaggttttggcattggagcctgggaaaaatccaagagccgtccaaacaaaacctggcctttttagaaccaatactggaaccataggtgccgtatccctagacttttcccctgggacgtcaggatctccaatcgttgacaaaaaaggaaaagttgtaggcctctatggcaatggtgtcgtcacaaggagtggagcatatgtgagtgccatagctcagactgaaaaaagcattgaagacaatccagagattgaagatgacatctttcgaaagagaagattgactatcatggatctccacccaggagcaggaaagacaaagaaatacctcccggccatagtcagagaggccataaaaagaggcttgagaacactaatccttgcccccactagagtcgtggcagctgagatggaggaagcccttagaggacttccaataagataccaaactccagctatcagggctgaacacaccgggcgggagatcgtggacttaatgtgtcatgccacatttaccatgaggctgctatcaccaatcagggtgccaaattacaacctgatcatcatggacgaagcccattttacagatccagcaagcatagcagctaggggatacatctcaactcgagtggagatgggtgaggcagctggaatttttatgacagccactcctccgggtagcagagatccatttcctcagagtaatgcaccaattatggatgaagaaagagaaattccggaacgttcatggaactccgggcacgagtgggtcacggattttaaaggaaagactgtctggtttgttccaagcataaaaaccggaaatgacatagcagcctgcctgagaaagaatggaaagagggtgatacagctcagtaggaagacctttgattctgaatacgtcaagactagaaccaatgactgggatttcgtggttacaactgacatttcggaaatgggtgccaactttaaagctgagagggttatagaccccagacgctgcatgaaaccagttatactgacagacggcgaagagcgggtgatcctggcaggacccatgccagtgacccactccagtgcagcacaaagaagagggagaataggaaggaatccaaggaatgaaaatgatcaatacatatatatgggagaacccctggaaaatgatgaagactgtgcgcactggaaggaagctaagatgctcctagataacatcaacacacctgaaggaattattcccagcatgttcgggccagagcgtgaaaaggtggatgccattgacggtgaatatcgcttgagaggagaagcacggaaaacttttgtggaactaatgagaagaggagacctaccagtctggttggcttataaagtggcatctgaaggtatcaactacgcagacagaagatggtgttttgacggaaccagaaacaatcaaatcttggaagaaaatgtggaagtggaaatctggacaaaggaaggggaaaggaaaaaattgaaacctagatggctagatgctaggatctactccgacccactggcgctaaaagaattcaaggaattcgcagccggaagaaagtctctaaccctgaacctaatcacagagatgggcagactcccaacttttatgactcagaaggccagagacgcactagacaacttggcggtgctgcacacggctgaagcgggtggaaaggcatacaatcatgctctcagtgaactaccggagaccctggaaacattgcttttgctgacactgctggccacagtcacgggaggaatctttctattcctgatgagcggaaggggtatagggaagatgaccctgggaatgtgttgcataatcacggccagcatcctcttatggtatgcacaaatacaaccacattggatagcagcttcaataatattggagttctttctcatagtcttgctcattccagaaccagaaaagcagaggacaccccaggataatcaattgacttatgtcatcatagccatcctcacagtggtggccgcaaccatggctaacgaaatgggttttctagaaaaaacaaagaaagacctcggactgggacacattgcaactcagcaacctgagagcaacattctggacatagatctacgtcctgcatcagcatggacgttgtatgccgtggctacaacatttatcacaccaatgttgagacatagcattgaaaattcttcagtaaatgtgtctctaacagccatagctaaccaagccacagtgctaatgggtctcgggaaaggatggccattgtcaaagatggacattggagttcccctccttgctattgggtgttactcacaagttaaccctataaccctcacagcggctcttcttttattggtagcacattatgccatcataggaccgggacttcaagccaaagcaaccagagaggctcagaaaagagcagcggcgggcatcatgaaaaacccaactgtggatggaataacagtgatagatctagatccaataccctatgatccaaagtttgaaaagcagttgggacaagtaatgctcctagtcctttgtgtgacccaagtgctgatgatgaggactacgtgggctttgtgtgaagccttaactctggcaactggacccgtgtccacattgtgggaaggaaatccagggagattctggaacacaaccattgcagtctcaatggcaaacatctttagagggagttaccttgctggagctggacttctcttttctatcatgaaaaacacaactagcacgagaagaggaactggcaacataggagaaacgctaggagagaaatggaaaagcagactgaacgcattggggaaaagtgaattccagatctacaaaaaaagtggaattcaagaagtggacagaaccttagcaaaagaaggcattaaaagaggagaaacggatcatcacgctgtgtcgcgaggatcagcaaaactgagatggttcgtcgaaagaaatttggtcacaccagaagggaaagtagtggaccttggctgcggcagagggggctggtcatactattgtggaggattgaagaatgtaagagaagttaaaggcttaacaaaaggaggaccaggacacgaagaacctatccctatgtcaacatatgggtggaatctagtacgcttacagagcggagttgacgttttttttattccaccagagaagtgtgacacactgttgtgtgacataggggaatcatcaccaaatcccacggtagaagcgggacgaacactcagggtccttaacctagtggaaagttggctgaacaataacacccaattttgcgtaaaggttcttaacccgtacatgccctcagtcattgaaagaatggaaaccttacaacggaaatacggaggagccttggtgagaaatccactctcacggaattccacacatgaaatgtactgggtgtccaatgcttccgggaacgtagtatcatcagtgaacatgatttcaagaatgctgattaacagattcaccatgagacacaagaaggccacctatgagccagatgtcgacctcggaagcggaacccgcaacattggaattgaaagtgagacaccgaacctagacataattgggaaaagaatagaaaaaataaaacaagagcatgaagcgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtctttaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacgaaaaaggtgagaagcaatgcagccttgggggccatatttaccgatgagaacaagtggaaatcggcacgtgaagctgttgaagataataggttttgggagctggttgacaaggaaagaaacctccatcttgaaggaaaatgtgaaacatgtgtatacaacatgatgggaaaaagagagaaaaaactaggagagtttggtaaagcaaaaggcagcagagccatatggtacatgtggctcggagcacgcttcttagagtttgaagccctaggatttttgaatgaagaccattggttctccagagagaactccctgagtggagtggaaggagaaggactgcataaactaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacataagaaacttgccgaggccatttttaaattgacgtaccaaaacaaggtggtgcgtgtgcaaagaccaacaccaataggtacagtaatggacatcatatcgagaagagaccaaaggggtagtgggcaagttggcacctatggcctcaacactttcaccaacatggaagcacaactaatcaggcaaatggagggggaaggaatcttcaaaagcatccagcacttgacagcctcagaagaaatcgctgtgcaagattggctagtaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtgcccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtactttcacagacgtgatctcaggctagcggcaaacgccatctgctcggcagtcccgtcacactgggttccaacaagccggacaacctggtccatacacgccagccatgaatggatgacgacggaagacatgttgacagtttggaacagagtgtggatcctagaaaatccatggatggaagacaaaactccagtggaatcatgggaggaaatcccatatctgggaaaaagagaagaccaatggtgcggctcgctgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtggtag

SEQ ID NO: 6558 - RNA, 9876 nt, synthetic construct
  misc_feature 1..9876: note = derived and/or modified CDS sequence (wt) from DENV-2__GQ868497__SS-prME
  source 1..9876: mol_type = other RNA
acagcaagcgtgattgttatgttgattccaacagtgatggcgttccatctaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgttccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacacccaggctttaccataatggcagcaatcctggcatacaccataggaacgacacattttcaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggactttgaactgataaaaacagaagccaaacaacctgccactctaaggaagtactgtatagaagcaaagctgaccaacacaacaacagaatcgcgttgcccaacacaaggggaacccagtctaaatgaagagcaggataaaaggttcatctgcaaacactccatggtagacagaggatggggaaatggatgtggattatttggaaagggaggcattgtgacctgtgctatgttcacatgcaaaaagaacatggaaggaaaagtcatgcagccagaaaatttggaatacaccatcgtgataacacctcactcaggagaagagcacgctgtgggtaatgacacaggaaagcatggcaaggaaatcaaaataacaccgcagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacatgtcttaggtcgcttgattacagtcaacccaatcgtaacagaaaaagatagcccagtcaatatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatccataggaaaggctctccaccaagtttttggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtgttttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctgggtaagcttgagatggacttcgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacgaaacatgcaatactgctagttgcagcatcttttgtgacattgattactgggaacatgtcttttagagacttgggaagagtgatggttatggtgggcgctaccatgacggatgacataggtatgggagtgacttatcttgccctactagcagcttttaaagttagaccaacttttgcagctggactactcttgagaaaactgacctccaaagaattgatgatggccaccataggaatcgcactcctttcccaaagcaccataccagagaccattcttgaactgactgatgcgttagccttgggcatgatggtcctcaaaatagtgagaaatatggaaaaataccaattggcagtgaccatcatggctatttcgtgtgtcccaaacgcagtgatactgcaaaacgcatggaaggtgagttgcacaatattggcagcggtgtccgtttctccactgctcttaacatcctcacagcagaaagcggattggataccactggcattgacgataaaaggtcttaatccaacagccatttttctaacaactctttcgagaaccagcaagaaaaggagctggccgctaaatgaagctgtcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccgatcctgtcaataacaatatcagaagatggcagcatgtcggtaaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccacacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacattcactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacagctcagtagaaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcacaaagaagagggagaataggaagaaatccaaaaaatgaaaacgaccagtacatatacatgggggaacctcttgaaaatgatgaagactgtgcacattggaaagaagctaaaatgctcctagacaacatcaacacacccgaaggaatcattcctagtatgttcgaaccagagcgtgaaaaagtggatgccattgatggtgaataccgtttgagaggggaagcaaggaaaacctttgtagacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctaaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgcttattccagaaccagaaaaacagagaacaccccaagacaaccaattgacctatgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggccacaacatttgtcacaccaatgttgagacatagcattgaaaattcctcagtgaatgtctccctaacggccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaactagagaagctcagaaaagagcagcagcaggtatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccatcatgaaaaacacaacaaacacaagaagaggaactggcaacataggagagacacttggagaaaaatggaaaagtcgactaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggctgcggtagagggggctggtcatactattgtgggggactaaaggatgtaagagaagtcaaaggcctaacaaaaggaggaccaggacatgaagaacccatccccatgtcaacatatgggtggaatctagtgcgtctgcaaagtggaatcgacgttttcttcaccccgccagaaaagtgtgatacattgctgtgtgacataggggagtcgtcaccaaatcccacgatagaggcaggacgaacactcagagtcctcaacttagtggaaaattggttgaacaataacacccaattttgcataaaggtcctcaacccatatatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacgagagcatgaaacatcatggcactatgatcaagaccacccatacaaaacgtgggcttaccatggtagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctatattttaagagacgtgggcaagaaggaagggggagcaatgtacgccgatgacacagcaggatgggacacaagaatcacactagaagacttaaaaaatgaagaaatggtaacaaaccacatgaaaggagaacacaagaaactagccgaggccatatttaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctgtcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaaaggaagaggaagaggcaggtgtcttgtggtag

SEQ ID NO: 6559 - RNA, 9876 nt, synthetic construct
  misc_feature 1..9876: note = derived and/or modified CDS sequence (wt) from DENV-2__GU131959__SS-prME
  source 1..9876: mol_type = other RNA
acagcaggcgtgattgttatgttgattccaacagtgatggcgttccatctaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgttccaccacaggagaacacagaagagaaaaaagatcagtggcgctcgttccacacgtgggtatgggactggagacacgaactgaaacatggatgtcatcagaaggggcctggaaacatgttcagagaattgaaacctggatcttgagacacccaggctttaccataatggcagcaatcctggcatacaccataggaacgacacattttcaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggactttgaactgataaaaacagaagccaaacaacctgccactctaaggaagtactgtatagaagcaaagctgaccaacacaacaacagaatcgcgttgcccaacacaaggggaacccagtctaaatgaagagcaggataaaaggttcatctgcaaacactccatggtagacagaggatggggaaatggatgtggattatttggaaagggaggcattgtgacctgtgctatgttcacatgcaaaaagaacatggaaggaaaagtcgtgcagccagaaaatttggaatacaccatcgtgataacacctcactcaggagaagagcacgctgtgggtaatgacacaggaaagcatggcaaggaaatcaaaataacaccgcagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaaaaaacaggatgtcgttgttttagggtctcaagaaggagccatgcacacggcactcacaggggccacagaaatccagatgtcatcaggaaacttactgttcacaggacatctcaagtgcaggctgagaatggacaaactacagctcaaaggaatgtcatactctatgtgcacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagtcaacccaatcgtaacagaaaaagatagcccagtcaatatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatccataggaaaggctctccaccaagttttcggagcaatctatggggctgcttttagtggggtctcatggactatgaaaatcctcataggagtcatcatcacatggataggaatgaatacacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgaaacatggaagatggagaaagcctccttcattgaagttaaaagctgctactggccaaagtcacacaccctttggagcaatggagtattagaaagtgagatgataatcccaaaaaattttgccgggccagtgtcacaacacaactacagaccaggctaccatacacaaacagcaggaccttggcatctgggtaagcttgagatggacttcgatctctgcgaagggactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacgaaacatgcaatactgctagttgcagcatcttttgtgacattaattactgggaacatgtcttttagagacttgggaagagtgatggttatggtgggcgcaaccatgacggatgacataggtatgggagtgacttatcttgccctactagcagcttttaaagttagaccaacttttgcagctggactactcttgagaaaactgacctccaaagaattgatgatggccaccataggaatcgcactcctttcccaaagcaccataccagagaccattcttgaactgactgatgcgttagccttgggcatgatggtcctcaaaatagtgagaaatatggaaaaataccaattggcagtgaccatcatggctatttcgtgtgtcccaaacgcagtgatactgcaaaacgcatggaaggtgagttgcacaatattggcagcggtgtccgtttccccactgctcttaacatcctcacagcagaaagcggattggataccactggcattgacgataaaaggtctcaatccaacagccatttttctaacaactctttcgagaaccagcaagaaaaggagctggccgctaaatgaagctgtcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccacacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcttggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacattcactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggagagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtagaaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcacaaagaagagggagaataggaagaaatccaaaaaatgaaaacgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtagacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctaaacctaatcacagaaatgggtaggcttccaactttcatgactcagaaagcaagaaacgcactggacaacttggctgtgctgcacacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagcatcctcctatggtatgcacagatacaaccacactggatagcagcttcaataatactggagttttttctcatagttttgcttattccagaaccagaaaaacagagaacaccccaagacaaccaattgacctatgttgtcatagccatcctcacagtggtggccgcaaccatggcaaacgagatgggtttcctggaaaaaaccaagaaagacctaggattgggaagcattacaacccaggaatctgagagtaatatcctggacatagatctacgccctgcatcagcatggacgctgtatgccgtggccacaacatttgtcacaccaatgttgagacatagcattgaaaattcctcagtgaatgtctccctaacggccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaactagagaagctcagaaaagagcagcagcaggtatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccatcatgaaaaacacaacaaacacaagaagaggaactggcaacataggagagacacttggagaaaaatggaaaagtcgactaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggctgcggtagagggggctggtcatactattgtgggggactaaaggatgtaagagaagtcaaaggcctaacaaaaggaggaccaggacatgaagaacccatccccatgtcaacatatgggtggaatctagtgcgtctgcaaagtggaatcgacgttttcttcaccccgccagaaaagtgtgatacattgttgtgtgacataggggagtcgtcaccaaatcccacgatagaggcaggacgaacactcagagtcctcaacttagtggaaaattggttgaacaataacacccaattttgcataaaggtcctcaacccatatatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatataaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaaggaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctatattttaagagacgtgggcaagaaggaagggggagcaatgtacgccgatgacacagcaggatgggacacaagaatcacactagaagacttaaaaaatgaagaaatggtaacaaaccacatgaaaggagaacacaagaaactagccgaggccatatttaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtagggcgtgaaaggctgtcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaaaggaagaggaagaggcaggtgtcttgtggtag

SEQ ID NO: 6560 - RNA, 9876 nt, synthetic construct
  misc_feature 1..9876: note = derived and/or modified CDS sequence (wt) from DENV-2__GQ868515__SS-prME
  source 1..9876: mol_type = other RNA
acagcaggcgtgattgttatgttgattccaacagtgatggcgttccatctaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatggataacttatgggacatgttccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacacccaggctttaccataatggcagcaatcctggcatacaccataggaacgacacattttcaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggactttgaactgataaaaacagaagccaaacaacctgccactctaaggaagtactgtatagaagcaaagctgaccaacacaacaacagaatcgcgttgcccaacacaaggggaacccagtctaaatgaagagcaggataaaaggttcatctgcaaacactccatggtagacagaggatggggaaacggatgtggattatttggaaagggaggcattgtgacctgtgctatgttcacatgcaaaaagaacatggaaggaaaagtcgtgcagccagaaaatttggaatacactatcgtgataacacctcactcaggagaagagcacgctgtgggtaatgacacaggaaagcatggcaaggaaatcaaaataacaccgcagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacgatatgaaggggacggttctccatgtaagatcccttttgagataacagattcggaaaaaagacacgtcttaggtcgcttgattacagtcaacccaatcgtaacagaaaaagatagtccagtcaatatagaagcagaacctccattcggagacagctacatcatcataggagtagagccgggacaattgaaactcaattggtttaagaaaggaagttccatcggccaaatgtttgagacaacaatgagaggagcaaagagaatggccattttaggtgacacagcctgggactttggatccctgggaggagtgtttacatccataggaaaggctctccaccaagttttcggagcaatctatggggctgcttttagtggggtctcatggactatgaaaatcctcataggagtcatcatcacatggataggaatgaactcacgtagcacctcactgtctgtgtcgctagtattggtgggtgtcgtgatactgtacctgggagctatggtgcaagctgatagtggttgcgttgtgagctggaaaaataaagaactgaaatgtggcagcgggatcttcatcacagataacgtacacacatggacagaacaatacaagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtcccacaatcagacttttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcacctgggtaagcttgagatggacttcgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacgaaacatgcaatactgctagttgcagcatcttttgtgacattgattactgggaacatgtcttttagagatttgggaagagtgatggttatggtgggcgctaccatgacggatgacataggtatgggagtgacttatcttgccctactagcagcttttaaagttagaccaacttttgcagctggactactcttgagaaaactgacctccaaagaattgatgatggccaccataggaatcgcactcctttcccaaagcaccataccagagagcattcttgaactgactgatgcgttagccttgggcatgatggtcctcaaaatagtgagaaatatggaaaaataccaattggcagtgaccatcatggctatttcgtgtgtcccaaacgcagtgatactgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctgtcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccacacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgaacataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaaaaaagtgatacaactcagtagaaagacttttgactctgagtatgttaagactagagccaatgattgggactttgtagtcacaactgacatttcagaaatgggtgccaacttcaaggctgagagggttatagaccccagacgttgcatgaaaccagtcatactaacagatggcgaagagcgggtgatcttggcaggacccatgccagtgacccactctagtgcagcacaaagaagagggagaataggaagaaatccaaaaaatgaaaacgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtagacctaatgagaagaggggacttaccagtctggttggcctacaaagtggcagctgaaggcatcaactacgcagacagaaagtggtgttttgatgggattaagaataaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctaaacctaatcacagaaatgggtaggcttccaactttcatgactcagaaagcaagaaacgcactggacaacttggctgtactgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacagctagtatcctcctatggtacgcacagatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggccacaacatttgtcacaccaatgttgagacatagcattgaaaattcctcagtgaatgtctccctaacggccattgctaaccaagctacagtgctaatgggtcttgggaaaggatggccattgtcaaagatggacattggagtccccctccttgccattggatgctattcacaagtcaaccctataactctcacagcagctcttcttttattggtagcacattatgccattatagggccaggacttcaagcaaaagcaactagagaagctcagaaaagagcagcagcaggtatcatgaaaaacccaacagtcgatggaataacagtgattgacctagaaccaataccctatgatccaaaatttgaaaagcagttaggacaagtaatgctcttaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccatcatgaaaaacacaacaaacacaagaagaggaactggcaacataggagagacacttggagaaaaatggaaaagtcgactaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgcgatggttcgtcgagagaaatatggtcacaccggaagggaaggtggtggatctcggttgcggtagagggggctggtcatactattgtgggggactaaaggatgtaagagaagtcaaaggcctaacaaaaggaggaccaggacatgaagaacccatccccatgtcaacatatgggtggaatctagtgcgtctgcaaagtggaatcgacgttttcttcaccccgccagaaaagtgtgatacattgttgtgtgacataggggagtcgtcaccaaatcccacgatagaggcaggacgaacactcagagtcctcaacttagtggaaaattggttgaacaataacacccaattttgcataaaggtcctcaacccatacatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaatattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccaaaggaaggtacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgacacagcaggatgggacacaagaatcacactagaagacttaaaaaatgaagaaatggtaacaaaccatatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaaacattcagcacctgacagccacagaagaaatcgctgtacagaactggttagcaagagtggggcgtgaaaggctgtcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaaccccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaaaggaagaggaagaggcaggtgtcttgtggtag

SEQ ID NO: 6561 - RNA, 9876 nt, synthetic construct
  misc_feature 1..9876: note = derived and/or modified CDS sequence (wt) from DENV-2__GQ868516__SS-prME
  source 1..9876: mol_type = other RNA
acagcaggcgtgattgttatgttgattccaacagtgatggcgttccatctaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatggataacttatgggacatgttccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacacccaggctttaccataatggcagcaatcctggcatacaccataggaacgacacattttcaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggactttgaactgataaaaacagaagccaaacaacctgccactctaaggaagtactgtatagaagcaaagctgaccaacacaacaacagaatcgcgttgcccaacacaaggggaacccagtctaaatgaagagcaggataaaaggttcatctgcaaacactccatggtagacagaggatggggaaacggatgtggattatttggaaagggaggcattgtgacctgtgctatgttcacatgcaaaaagaacatggaaggaaaagtcgtgcagccagaaaatttggaatacactatcgtgataacacctcactcaggagaagagcacgctgtgggtaatgacacaggaaagcatggcaaggaaatcaaaataacaccgcagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagtcaacccaatcgtaacagaaaaagatagtccagtcaatatagaagcagaacctccattcggagacagctacatcatcataggagtagagccgggacaattgaaactcaattggtttaagaaaggaagttccatcggccaaatgtttgagacaacaatgagaggagcaaagagaatggccattttaggtgacacagcctgggactttggatccctgggaggagtgtttacatccataggaaaggctctccaccaagttttcggagcaatctatggggctgcttttagtggggtctcatggactatgaaaatcctcataggagtcatcatcacatggataggaatgaactcacgtagcacctcactgtctgtgtcgctagtattggtgggtgtcgtgatactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtcccacaatcagacttttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcacctgggtaagcttgagatggacttcgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacgaaacatgcaatactgctagttgcagcatcttttgtgacattgattactgggaacatgtcttttagagatttgggaagagtgatggttatggtgggcgctaccatgacggatgacataggtatgggagtgacttatcttgccctactagcagcttttaaagttagaccaacttttgcagctggactactcttgagaaaactgacctccaaagaattgatgatggccaccataggaatcgcactcctttcccaaagcaccataccagagagcattcttgaactgactgatgcgttagccttgggcatgatggtcctcaaaatagtgagaaatatggaaaaataccaattggcagtgaccatcatggctatttcgtgtgtcccaaacgcagtgatactgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctgtcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccacacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgaacataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaaaaaagtgatacaactcagtagaaagacttttgactctgagtatgttaagactagagccaatgattgggactttgtagtcacaactgacatttcagaaatgggtgccaacttcaaggctgagagggttatagaccccagacgttgcatgaaaccagtcatactaacagatggcgaagagcgggtgatcttggcaggacccatgccagtgacccactctagtgcagcacaaagaagagggagaataggaagaaatccaaaaaatgaaaacgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtagacctaatgagaagaggggacttgccagtctggttggcctacaaagtggcagctgaaggcatcaactacgcagatagaaagtggtgttttgatgggattaagaataaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctaaacctaatcacagaaatgggtaggcttccaactttcatgactcagaaagcaagaaacgcactggacaacttggctgtactgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacagctagtatcctcctatggtacgcacagatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggccacaacatttgtcacaccaatgttgagacatagcattgaaaattcctcagtgaatgtctccctaacggccattgctaaccaagctacagtgctaatgggtcttgggaaaggatggccattgtcaaagatggacattggagtccccctccttgccattggatgctattcacaagtcaaccctataactctcacagcagctcttcttttattggtagcacattatgccattatagggccaggacttcaagcaaaagcaactagagaagctcagaaaagagcagcagcaggtatcatgaaaaacccaacagtcgatggaataacagtgattgacctagaaccaataccctatgatccaaaatttgaaaagcagttaggacaagtaatgctcttaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccatcatgaaaaacacaacaaacacaagaagaggaactggcaacataggagagacacttggagaaaaatggaaaagtcgactaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgcgatggttcgtcgagagaaatatggtcacaccggaagggaaggtggtggatctcggttgcggtagagggggctggtcatactattgtgggggactaaaggatgtaagagaagtcaaaggcctaacaaaaggaggaccaggacatgaagaacccatccccatgtcaacatatgggtggaatctagtgcgtctgcaaagtggaatcgacgttttcttcaccccgccagaaaagtgtgatacattgttgtgtgacataggggagtcgtcaccaaatcccacgatagaggcaggacgaacactcagagtcctcaacttagtggaaaattggttgaacaataacacccaattttgcataaaggtcctcaacccatatatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaatattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccaaaggaaggtacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgacacagcaggatgggacacaagaatcacactagaagacttaaaaaatgaagaaatggtaacaaaccatatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaaacattcagcacctgacagccacagaagaaatcgctgtacagaactggttagcaagagtggggcgtgaaaggctgtcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaaccccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaaaggaagaggaagaggcaggtgtcttgtggtag

SEQ ID NO: 6562 - RNA, 9876 nt, synthetic construct
  misc_feature 1..9876: note = derived and/or modified CDS sequence (wt) from DENV-2__GU131975__SS-prME
  source 1..9876: mol_type = other RNA
acagcaggcgtgattgttatgttgattccaacagtgatggcgtttcatctaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatggataacttatgggacatgttccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacacccaggctttaccataatggcagcaatcctggcatacaccataggaacgacacattttcaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggactttgaactgataaaaacagaagccaaacaacctgccactctaaggaagtactgtatagaagcaaagctgaccaacacaacaacagaatcgcgttgcccaacacaaggggaacccagtctaaatgaagagcaggataaaaggttcatctgcaaacactccatggtagacagaggatggggaaacggatgtggattatttggaaagggaggcattgtgacctgtgctatgttcacatgcaaaaagaacatggaaggaaaagtcgtgcagccagaaaatttggaatacactatcgtgataacacctcactcaggagaagagcacgctgtgggtaatgacacaggaaagcatggcaaggaaatcaaaataacaccgcagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtcccaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagtcaacccaatcgtaacagaaaaagatagtccagtcaatatagaagcagaacctccattcggagacagctacatcatcataggagtagagccgggacaattgaaactcaattggtttaagaaaggaagttccatcggccaaatgtttgagacaacaatgagaggagcaaagagaatggccattttaggtgacacagcctgggactttggatccctgggaggagtgtttacatccataggaaaggctctccaccaagttttcggagcaatctatggggctgcttttagtggggtctcatggactatgaaaatcctcataggagtcatcatcacatggataggaatgaactcacgtagcacctcactgtctgtgtcgctagtattggtgggtgtcgtgatactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtcccacaatcagacttttcttattgatggccctgaaacagcagaatgccccaacacaaacagagcttggaactcgctggaagttgaagactatggttttggagttttcaccaccaatatatggttgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtactagaaagtgagatgataatcccaaaaaattttgccgggccagtgtcacaacacaactacagaccaggctaccatacacaaacagcaggaccttggcacctgggtaagcttgagatggacttcgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacgaaacatgcaatactgctagttgcagcatcttttgtgacattgattactgggaacatgtcttttagagatttgggaagagtgatggttatggtgggcgctaccatgacggatgacataggtatgggagtgacttatcttgccctactagcagcttttaaagttagaccaacttttgcagctggactactcttgagaaaactgacctccaaagaattgatgatggccaccataggaatcgcactcctttcccaaagcaccataccagagagcattcttgaactgactgatgcgttagccttgggcatgatggtcctcaaaatagtgagaaatatggaaaaataccaattggcagtgaccatcatggctatttcgtgtgtcccaaacgcagtgatactgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctgaatgaagctgtcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccacacaatgtggcacgtcacacgtggtgctgttctgatgcatagaggaaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaaaaaagtgatacaactcagtagaaagacttttgactctgagtatgttaagactagagccaatgattgggactttgtagtcacaactgacatttcagaaatgggtgctaacttcaaggctgagagggttatagaccccagacgttgcatgaaaccagtcatactaacagatggcgaagagcgggtgatcttggcaggacctatgccagtgacccactctagtgcagcacaaagaagagggagaataggaagaaatccaaaaaatgaaaacgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtagacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctaaacctaatcacagaaatgggtaggcttccaactttcatgactcagaaagcaagaaacgcactggacaacttggctgtactgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacagctagtatcctcctatggtacgcacagatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggccacaacatttgtcacaccaatgttgagacatagcattgaaaattcctcagtgaatgtctccctaacggccattgctaaccaagctacagtgctaatgggtcttgggaaaggatggccattgtcaaagatggacattggagtccccctccttgccattggatgctattcacaagtcaaccctataactctcacagcagctcttcttttattggtagcacattatgccattatagggccaggacttcaagcaaaagcaactagagaagctcagaaaagagcagcagcaggtatcatgaaaaacccaacagtcgatggaataacagtgattgacctagaaccaataccctatgatccaaaatttgaaaagcagttgggacaagtaatgctcttaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccatcatgaaaaacacaacaaacacaagaagaggaactggcaacataggagagacacttggagaaaaatggaaaagtcgactaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgcgatggttcgtcgagagaaatatggtcacaccggaagggaaggtggtggatctcggttgcggtagagggggctggtcatactattgtgggggactaaaggatgtaagagaagtcaaaggcctaacaaaaggaggaccaggacatgaagaacccatccccatgtcaacatatgggtggaatctagtgcgtctgcaaagtggaatcgacgttttcttcaccccgccagaaaagtgtgatacattgttgtgtgacataggggagtcgtcaccaaatcccacgatagaggcaggacgaacactcagagtcctcaacttagtggaaaattggttgaacaataacacccaattttgcataaaggtcctcaacccatatatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaatattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccaaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaagtctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgacacagcaggatgggacacaagaatcacactagaagacttaaaaaatgaagaaatggtaacaaaccatatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaaacattcagcacctgacagccacagaagaaatcgctgtacagaactggttagcaagagtggggcgtgaaaggctgtcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaaaggaagaggaagaggcaggtgtcttgtggtag

SEQ ID NO: 6563 - RNA, 9876 nt, synthetic construct
  misc_feature 1..9876: note = derived and/or modified CDS sequence (wt) from DENV-2__JN819422__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactccacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgtccagagaattgaaacctggatcttgagacatccaggctttaccataatggcagcaatcctggcatacaccataggaacgacacatttccaaaaggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaataaaccaacactggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgactttaatgagatggtgctgctgcagatggaagacaaagcttggctggtgcacaggcaatggttcctagacctgccgttaccatggctacctggagcggacacacaaggatcaaattggatacagaaagagacattggtcactttcaaaaatccccacgcgaagaaacaggatgtcgtcgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaacaaagaactgaaatgtggcagcgggatcttcatcacagataacgtacacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcagccattaaagacaatagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgataacttttcactaggagtcttgggaatggcactgttcctggaagaaatgctcaggacccgaataggaacgaaacatgcaatactgctagtcgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatcgcactcctttcccaaagcaccataccagagaccattcttgaactgaccgatgcattagccttgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttctaacaactctttcgagaaccagcaaaaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctatcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccctcacccccaccagtggaaaaagccgaactggaggatggagcctacagaatcaagcaaagagggattcttggatattctcagatcggagccggagtttacaaagaaggaacattccatacaatgtggcacgtcacacgtggtgctgttctgatgcatagagggaagaggattgaaccatcatgggcagatgtcaagaaagacctaatatcatatggaggaggttggaagctagaaggagaatggaaggaaggggaggaagtccaagtcctggcactggaacctgggaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgccatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccaccagagtagtggcagctgaaatggaggaagctcttagaggacttccaataagataccaaaccccagccatcaaaacccagcataccgggcgggagatcgtggacctaatgtgtcatgccacatttactatgaggctgctatcaccagtcagagtaccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaattcctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaactttaaggctgagagggttatagaccccagacgttgcatgaaaccagttatactaacagatggcgaagagcgggtgatcttggcaggaccaatgccagtgacccactctagtgcagcgcaaagaagagggagaataggaagaaatccaaagaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacttttgtggacctaatgagaagaggggacttaccagtctggttggcctacaaagtggcagctgaaggcatcaactacgcagacagaaagtggtgttttgatggaatcaagaacaaccaaatactggaagaaaatatagaagtggaaatctggacaaaagaaggggagaggaaaaaattaaaacccagatggttggatgctaggatctattctgacccactggcactaaaagaattcaaggaatttgcagctggaagaaaatctctgaccctgaacctgatcacagaaatgggtaggcttccaactttcatgactcagaaagcaagaaacgcactggacaacttggctgtgctgcatacggctgaggcaggtggaagggcgtacaatcatgctctcagtgaactgccggagaccctggaaacactgcttctactgacactcctggcaacagtcacaggaggaatcttcttattcttaatgagcggaaaaggtgtagggaagatgaccctgggaatgtgttgcataatcacggctagcatcctcctatggtatgcacagatacaaccacactggatagcagcttcaataatactggagttttttctcatagttttgctcattccagaaccagaaaaacagagaacaccccaagacaaccaattgacctacgttgtcatagccattctcacagtggtggccgcaaccatggcaaacgagatgggtttcctagaaaaaaccaagaaagacctcggattgggaagcattacaacccaggaatctgagagcaatatcctggacatagatctacgccctgcatcagcatggacgctgtatgccgtggccacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggtatcatgaaaaacccaacagtagatggaataacagtgattgacctagaaccaataccctatgatccaaaatttgaaaagcagttaggacaagtaatgctcctaattctctgcgtgactcaagtattaatgatgaggactacatgggctctgtgtgaggctctaaccttagcgaccgggcctatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaagtctacaagaaaagtggaatccaggaagtggatagaaccctagcaaaagaaggtatcaaaagaggagaaacggaccaccatgctgtgtcgcgaggttcagctaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtttgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagatcacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaggaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaagggaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctatattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacgccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggggatgattgtgttgtaaaacctatagatgatagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgccacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6564 - RNA, 9876 nt, synthetic construct
  misc_feature 1..9876: note = derived and/or modified CDS sequence (wt) from DENV-2__GU131955__SS-prME
  source 1..9876: mol_type = other RNA
acagcaggcgtgattgttatgttgattccaacagtgatggcgttccatctaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgttccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacacccaggctttaccataatggcagcaatcctggcatacaccataggaacgacacattttcaaagggccttgattttcatcttactgacagctgtcgctccttcaatgacaatgcgctgcataggaatatcaaacagagacttcgtagaaggggtttcaggaggaagctgggttgacatagtcttagaacatggaagttgtgtgacgacgatggcaaaaaacaaaccaacattggactttgaactgataaaaacagaagccaaacaacctgccactctaaggaagtactgtatagaagcaaagctgaccaacacaacaacagaatcgcgttgcccaacacaaggggaacccagtctaaatgaagagcaggataaaaggttcatctgcaaacactccatggtagacagaggatggggaaatggatgtggattatttggaaagggaggcattgtgacctgtgctatgttcacatgcaaaaagaacatggaaggaaaagtcgtgcagccagaaaatttggaatacaccatcgtgataacacctcactcaggagaagagcacgctgtgggtaatgacacaggaaagcatggcaaggaaatcaaaataacaccgcagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagtcaacccaatcgtaacagaaaaagatagcccagtcaatatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatccataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacagtataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcacttaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctatcatacacaaacagcaggaccttggcatctgggtaagcttgagatggacttcgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcattaggagtcttgggaatggcactgttcctggaagaaatgctcaggacccgaataggaacgaaacatgcaatactgctagttgcagcatcttttgtgacattgattactgggaacatgtcttttagagacttgggaagagtgatggttatggtgggcgctaccatgacggatgacataggtatgggagtgacttatcttgccctactagcagcttttaaagttagaccaacttttgcagctggactactcttgagaaaactgacctccaaagaattgatgatggccaccataggaatcgcactcctttcccaaagcaccataccagagaccattcttgaactgactgatgcgttagccttgggcatgatggtcctcaaaatagtgagaaatatggaaaaataccaattggcagtgaccatcatggctatttcgtgtgtcccaaacgcagtgatactgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctgtcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccacacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgcaatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtagaaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcacaaagaagagggaggataggaagaaatccaaaaaatgaaaacgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtagacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctaaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggccacaacatttgtcacaccaatgttgagacatagcattgaaaattcctcagtgaatgtctccctaacggccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaactagagaagctcagaaaagagcagcagcaggtatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccatcatgaaaaacacaacaaacacaagaagaggaactggcaacataggagagacacttggagaaaaatggaaaagtcgactaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggtagagggggctggtcatactattgtgggggactaaaggatgtaagagaagtcaaaggcctaacaaaaggaggaccaggacatgaagaacccatccccatgtcaacatatgggtggaatctagtgcgtctgcaaagtggaatcgacgttttcttcaccccgccagaaaagtgtgatacattgttgtgtgacataggggagtcgtcaccaaatcccacgatagaggcaggacgaacactcagagtcctcaacttagtggaaaattggttgaacaataacacccaattttgcataaaggtcctcaacccatatatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgacacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaaggccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctgtcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagagtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaaaagattcagaaaggaagaggaagaggcaggtgtcttgtggtag

SEQ ID NO: 6565 - RNA, 9876 nt, synthetic construct
  misc_feature 1..9876: note = derived and/or modified CDS sequence (wt) from DENV-2__KJ189311__SS-prME
  source 1..9876: mol_type = other RNA
acagcaggcgtgattgttatgttgattccaacagtgatggcgtttcatctaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatggataacttatgggacatgttccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacacccaggctttaccataatggcagcaatcctggcatacaccataggaacgacacattttcaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggactttgaactgataaaaacagaagccaaacaacctgccactctaaggaagtactgtatagaagcaaagctgaccaacacaacaacagaatcgcgttgcccaacacaaggggaacccagtctaaatgaagagcaggataaaaggttcatctgcaaacactccatggtagacagaggatggggaaacggatgtggattatttggaaagggaggcattgtgacctgtgctatgttcacatgcaaaaagaacatggaaggaaaagtcgtgcagccagaaaatttggaatacactatcgtgataacacctcactcaggagaagagcacgctgtgggtaatgacacaggaaagcatggcaaggaaatcaaaataacaccgcagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtcccaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagtcaacccaatcgtaacagaaaaagatagtccagtcaatatagaagcagaacctccattcggagacagctacatcatcataggagtagagccgggacaattgaaactcaattggtttaagaaaggaagttccatcggccaaatgtttgagacaacaatgagaggagcaaagagaatggccattttaggtgacacagcctgggactttggatccctgggaggagtgtttacatccataggaaaggctctccaccaagttttcggagcaatctatggggctgcttttagtggggtctcatggactatgaaaatcctcataggagtcatcatcacatggataggaatgaactcacgtagcacctcactgtctgtgtcgctagtattggtgggtgtcgtgatactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtcccacaatcagacttttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtactagaaagtgagatgataatcccaaaaaattttgccgggccagtgtcacaacacaactacagaccaggctaccatacacaaacagcaggaccttggcacctgggtaagcttgagatggacttcgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacgaaacatgcaatactgctagttgcagcatcttttgtgacattgattactgggaacatgtcttttagagatttgggaagagtgatggttatggtgggcgctaccatgacggatgacataggtatgggagtgacttatcttgccctactagcagcttttaaagttagaccaacttttgcagctggactactcttgagaaaactgacctccaaagaattgatgatggccaccataggaatcgcactcctttcccaaagcaccataccagagagcattcttgaactgactgatgcgttagccttgggcatgatggtcctcaaaatagtgagaaatatggaaaaataccaattggcagtgaccatcatggctatttcgtgtgtcccaaacgcagtgatactgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctgaatgaagctgtcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccacacaatgtggcacgtcacacgtggtgctgttctgatgcatagaggaaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatctagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaaaaaagtgatacaactcagtagaaagacttttgactctgagtatgttaagactagagccaatgattgggactttgtagtcacaactgacatttcagaaatgggtgctaacttcaaggctgagagggttatagaccccagacgttgcatgaaaccagtcatactaacagatggcgaagagcgggtgatcttggcaggacctatgccagtgacccactctagtgcagcacaaagaagagggagaataggaagaaatccaaaaaatgaaaacgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtagacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctaaacctaatcacagaaatgggtaggcttccaactttcatgactcagaaagcaagaaacgcactggacaacttggctgtactgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacagctagtatcctcctatggtacgcacagatacaaccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggccacaacatttgtcacaccaatgttgagacatagcattgaaaattcctcagtgaatgtctccctaacggccattgctaaccaagctacagtgctaatgggtcttgggaaaggatggccattgtcaaagatggacattggagtccccctccttgccattggatgctattcacaagtcaaccctataactctcacagcagctcttcttttattggtagcacattatgccattatagggccaggacttcaagcaaaagcaactagagaagctcagaaaagagcagcagcaggtatcatgaaaaacccaacagtcgatggaataacagtgattgacctagaaccaataccctatgatccaaaatttgaaaagcagttaggacaagtaatgctcttaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccatcatgaaaaacacaacaaacacaagaagaggaactggcaacataggagagacacttggagaaaaatggaaaagtcgactaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgcgatggttcgtcgagagaaatatggtcacaccggaagggaaggtggtggatctcggttgcggtagagggggctggtcatactattgtgggggactaaaggatgtaagagaagtcaaaggcctaacaaaaggaggaccaggacatgaagaacccatccccatgtcaacatatgggtggaatctagtgcgtctgcaaagtggaatcgacgttttcttcaccccgccagaaaagtgtgatacattgttgtgtgacataggggagtcgtcaccaaatcccacgatagaggcaggacgaacactcagagtcctcaacttagtggaaaattggttgaacaataacacccaattttgcataaaggtcctcaacccatatatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaatattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccaaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaagtctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgacacagcaggatgggacacaagaatcacactagaagacttaaaaaatgaagaaatggtaacaaaccatatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaaacattcagcacctgacagccacagaagaaatcgctgtacagaactggttagcaagagtggggcgtgaaaggctgtcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaaaggaagaggaagaggcaggtgtcttgtggtag

SEQ ID NO: 6566 - RNA, 9876 nt, synthetic construct
  misc_feature 1..9876: note = derived and/or modified CDS sequence (wt) from DENV-2__KJ189370__SS-prME
  source 1..9876: mol_type = other RNA
acagcaggcgtgattgttatgttgattccaacggcgatggcgttccatttgaccacacgcaatggagaaccacacatgatcgttagtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggttttaccataatggcagcaatcttggcatacactataggaacgacacatttccaaagggccttgattttcatcttgctgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaaccagccactctaaggaagtactgtatagaagcaaagctgaccaacacaacaacagaatcacgttgtccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaatatggaaggaaaagtcgtgcagccagaaaacttggaatacaccatcgtgataacaccccactcaggagaagagcacgctgtaggtaatgacacaggaaagcatggcaaagaaatcaagataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaactggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtgcaatatgaaggggacggttctccatgtaagatcccttttgagataacagatttggaaaaaagacacgtcttaggtcgcttgatcacagttaacccaatcgtaacagaaaaagatagcccagtcaacatagaagcagaacctccattcggagacagctacattatcataggagtagagccgggacaattgaaactcaattggtttaagaagggaagttccatcggccaaatgtttgagacaacaatgagaggagcaaagagaatggccattctaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatttgatgtggaaacaaataacaccagaattgaaccatattctatcagaaaatgaggtaaagttgaccattatgacaggagacattaaaggaatcatgcaggcaggaaaacgatctttgcggccccagcccactgagctgaagtattcatggaaaacatgggggaaggcgaaaatgctctccacagagtctcacaatcagacctttcttattgatggccctgaaacagcagaatgccccaacacaaacagagcttggaactcactggaagttgaagactatggttttggagttttcaccaccaatatatggctgaaattgaaagaaaaacaggatgtattttgtgactcaaaactcatgtcagcggccattaaagacaacagagccgttcatgccgatatgggttattggatagaaagcgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagaaaaagaggagaatttggtcaactccttggtcacagccggacatgggcagattgacaacttttcattaggagtcctgggaatggcactgttcctggaagaaatgctcaggacccgaataggaacgaaacatgcaatactgctagttgcagtatcttttgtgacattgataactgggaacatgtcctttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaactgatgatggccaccataggaatcgcgctcctttcccaaagcaccataccagagaccattcttgaactgactgatgcattagccttgggcatgatggtcctcaaagtggtgagaaatatggaaaaataccaattggcagtgactatcatggctatttcgtgtgtcccaaatgcagtgatactgcaaaacgcatggaaggtgagttgcacaatattggcggcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctcttctaaagaatgacattcctatgacaggtccattagtggctggagggctccttaccgtatgttatgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgagctggaggatggagcctacagaatcaagcaaagagggattcttggatattctcagataggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctgggaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagacgacattttccggaagaaaagattgaccatcatggacctccatccaggagcaggaaagacaaaaagataccttccagccatagttagagaagccataaaacgtggcttgagaacattgatcttggctcccactagagtagtggcagctgaaatggaggaagctcttagaggacttccaataagataccaaaccccagccatcaaagccgagtataccgggcgggagatcgtggacctaatgtgtcatgccacatttactatgaggttgctatcaccagtcagagtgccaaattacaacctgatcatcatggacgaagcccacttcacagacccagctagtatagcagctagaggatacatctcaactcgagtagagatgggtgaagcagctgggattttcatgacagccactcctccgggaagtagagacccatttcctcagagcaacgcaccgatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatctcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataatatcaatacacccgaaggaatcattcctagtatgttcgaaccagagcgtgaaaaagtggatgccattgatggtgaataccgcttgagaggggaagcaaggaaaacctttgtggacctaatgagaagaggggacttaccagtctggttggcctacaaagtggcagctgaaggcattaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcacacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacagctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaatatcctggacatagatctacgccctgcatcagcatggacgctgtatgccgtggctacaacatttctcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccagggcttcaagcaaaagcaaccagagaagctcagaaaagagcagcagcaggcatcatgaaaaacccaacagtcgatggaataacagtgattgacctagacccaataccctatgatccaaaatttgaaaagcagctaggacaagtgatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaagcacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgccgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacactcagagtcctcaacttagtggaaaattggttaaacaataacactcaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgatctaggaagtggaacccgtaacatcggaattgaaagtgaggtaccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacagcagagtggctttggaaagaactaggaaagaaaaagacacccaggatgtgtaccagagaagaattcacaagaaaagtgagaagcaacgcagccttgggggccatattcactgatgagaacaaatggaaatcggcacgtgaggctgttgaagatggcaggttttgggagctggttgacagggaaagaaatctccatcttgaaggaaagtgtgaaacatgtgtgtataacatgatgggaaaaagagagaagaaactgggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagaagtgggcaagaaggaagggggagcaatgtacgccgatgacacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaagagaccaaagaggcagtgggcaagtcggcacctatggccttaacactttcaccaatatggaagcccaattaattagacagatggagggagaaggaatcttcaaaagcattcagcacctgacagccacagaagaaatcgctgtacagaactggttagtaagagtggggcgtgaaaggctatcaagaatggcaatcagtggagatgattgtgttgtaaaacctatagatgacagatttgcaagtgctttaacagctctaaatgacatgggaaaagttagaaaagacatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccatagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacttgggcaaagaatatccaaacagcaataaatcaagttagatcccttataggcaatgaggaatacacagactacatgccatccatgaagagattcagaagggaagaggaagaggcaggtgtcctgtggtag

SEQ ID NO: 6567 - RNA, 9876 nt, synthetic construct
  misc_feature 1..9876: note = derived and/or modified CDS sequence (wt) from DENV-2__EU482620__SS-prME
  source 1..9876: mol_type = other RNA
acagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagaaccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacttttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagtccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcttggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagatatcttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggagccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacacagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttctatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccaccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacccaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgagtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6568 - RNA, 9876 nt, synthetic construct
  misc_feature 1..9876: note = derived and/or modified CDS sequence (wt) from DENV-2__FJ373300__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaaccatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacagtattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 6569 - RNA, 9876 nt, synthetic construct
  misc_feature 1..9876: note = derived and/or modified CDS sequence (wt) from DENV-2__EU596495__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacaggaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacttagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 6570 - RNA, 9876 nt, synthetic construct
  misc_feature 1..9876: note = derived and/or modified CDS sequence (wt) from DENV-2__EU596497__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaataacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcatacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 6571 - RNA, 9876 nt, synthetic construct
  misc_feature 1..9876: note = derived and/or modified CDS sequence (wt) from DENV-2__EU569695__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatccctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccgtcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 6572 - RNA, 9876 nt, synthetic construct
  misc_feature 1..9876: note = derived and/or modified CDS sequence (wt) from DENV-2__EU482623__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaagaatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgcttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacagcggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccattgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgagggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 6573 - RNA, 9876 nt, synthetic construct
  misc_feature 1..9876: note = derived and/or modified CDS sequence (wt) from DENV-2__EU569698__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaaatactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagactcatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacattggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 6574 - RNA, 9876 nt, synthetic construct
  misc_feature 1..9876: note = derived and/or modified CDS sequence (wt) from DENV-2__EU569699__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtaggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaaaggaggcattgtgacctgtgctaagtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttatcgatggccctgaaacagcagaatgccccaacacaaacagagcctggaactcgctggaagttgaagactatggttttggagttttcaccaccaatatatggctgaaattgagagataaacaggatgtattttgtgactcaaaactcatgtcagcggccattaaagacaacagagccgttcatgctgatatgggttattggatagaaagtgcactcaatgacacatggaagatggaaaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtatgggatggaaatcagaccattgaaagagaaagaagagaatttggtcaactccttggtcacagccggacatgggcagattgacaacttttcactaggagtcttgggaatggcactgctcctggaagaaatgctcaggacccgaataggaacgaaacatgcaatactactagttgcagtgtcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctgggctactcttaagaaaactgacctccaaggaattgatgatggccaccataggaatcgcactcctttcccaaagcaccataccagaaaccattcttgaactgactgatgcattagccctgggcatgatggtcctcaaaatagtgagaaatatggaaaaataccaattggcagtgactgtcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgattatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgcgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatatggacaaaagaaggggaaaggaaaaagttaaaacccagatggttggatgctaggatctattctgacccactagcactaaaagaattcaaggaatttgcagctggaagaaaatctttgaccctgaacctaatcacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccggacccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaggaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaagcaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcattggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacttatggccttaataccttcaccaatatggaagcccaattaattagacagatggagggagaaggaatcttcaaaagcattcagcacctgacagccatagaagaaatcgctgtacagaactggctagcaagagtggggcgtgaaaggctatcaagaatggcaatcagtggagatgattgtgttataaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttggggaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaaccaagtcagatcccttataggcaatgaggaatacacagactacatgccatccatgaagagatttagaagggaagaggaagaggcaggtgtcctgtggtag

SEQ ID NO: 6575 - RNA, 9876 nt, synthetic construct
  misc_feature 1..9876: note = derived and/or modified CDS sequence (wt) from DENV-2__KF955366__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaaatactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgttccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgctacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccacttctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 6576 - RNA, 9876 nt, synthetic construct
  misc_feature 1..9876: note = derived and/or modified CDS sequence (wt) from DENV-2__EU569700__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaaatactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 6577 - RNA, 9876 nt, synthetic construct
  misc_feature 1..9876: note = derived and/or modified CDS sequence (wt) from DENV-2__KF955369__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacaactgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagatagaaagtggtgttttgatggaattaagaacaaccaaatactggaagaaaatatggaagtggaaatctggacaaaagaaggggaaaggaaaaaattaaaacccagatggttggatgctaggatctattctgacccactggcattaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggagaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 6578 - RNA, 9876 nt, synthetic construct
  misc_feature 1..9876: note = derived and/or modified CDS sequence (wt) from DENV-2__EU569702__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgcatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaatccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagactggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaaatactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagagagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcggcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcacaccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatagcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagacctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgcgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 6579 - RNA, 9876 nt, synthetic construct
  misc_feature 1..9876: note = derived and/or modified CDS sequence (wt) from DENV-2__EU482624__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcaaacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacatacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgcacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcacgagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 6580 - RNA, 9876 nt, synthetic construct
  misc_feature 1..9876: note = derived and/or modified CDS sequence (wt) from DENV-2__EU596500__SS-prME
  source 1..9876: mol_type = other RNA
acagcaggtgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgccatgtttacatgcaaaaagaacatggaaggaaaagtcgtgcagccagaaaacttggagtacaccatcgtgataacaccacactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctaagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagccatccaaaaagctcatgaagagggcatttgtggaatccgctcagtaacaagattggagaatctgatgtggaaacaaataacaccagaattgaatcatattctatcagaaaatgaggtaaaattgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatggtaatcccaaaaaattttgccgggccagtgtcacaacacaactacagaccaggctaccatacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaattgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagtccaatcctgtcaataacgatatcagaagatggcagcatgtcgataaaaaatgaagaggaagaacaaacactgaccatacttatcagaacgggattgttggtgatctcaggagtctttccagtatcgataccaatcacggcagcagcatggtacctgtgggaagtaaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgatcagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggaaaccctggagacactgcttctactgacactcctggcaacagtcacaggaggaatcttcttattcttaatgagtggaaaaagtatagggaagatgaccctgggaatgtgttgcataatcacggctagcatcctcctatggcatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggatatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctctttgccattggatgctattaccaagtcaaccctataactctaacagcagctcttcttctattggtagcacataatgccattataggccaaggactacaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtgatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcgacatatgggtggaatctagtgcgtctgcaaagtggagttgacgttttcttcaccccgccggaaaagtgtgacacattgctgtgtgacataggggagtcgtcaccaaaccccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgatcaacagattcacaatgaaacacaagaaagccacttacgagccagatgttgacctaggaagtggaacccgcaacattggaattgaaaatgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggtaatgaggaatacacagattacatgccatccatgaagagattcagaagggaagaggaagaggcaggtgtcctgtggtag

SEQ ID NO: 6581 - RNA, 9876 nt, synthetic construct
  misc_feature 1..9876: note = derived and/or modified CDS sequence (wt) from DENV-2__EU482626__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacatacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactcagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 6582 - RNA, 9876 nt, synthetic construct
  misc_feature 1..9876: note = derived and/or modified CDS sequence (wt) from DENV-2__EU482629__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaaatcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactccatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggttaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttaaagacctgggaagagtgatggttatgatgggcgctaccatgacggatgacataggtatgggagtgacttatcttgccctactagctgcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaagatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatacgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagcataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaattacagaaatgggtaggcttccaactttcatgacccagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggcatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttatcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaactctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatttagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcatccagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaaattagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6583 - RNA, 9876 nt, synthetic construct
  misc_feature 1..9876: note = derived and/or modified CDS sequence (wt) from DENV-2__FJ390390__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtaggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaaaggaggcattgtgacctgtgctaagtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttatcgatggccctgaaacagcagaatgccccaacacaaacagagcctggaactcgctggaagttgaagactatggttttggagttttcaccaccaatatatggctgaaattgagagataaacaggatgtattttgtgactcaaaactcatgtcagcggccattaaagacaacagagccgttcatgctgatatgggttattggatagaaagtgcactcaatgacacatggaagatggagaaagcctccttcattgaagtcaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtatgggatggaaatcagaccattgaaagagaaagaagagaatttggtcaactccttggtcacagccggacatgggcagattgacaacttttcactaggagtcttgggaatggcactgctcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctgggctactcttaagaaaactgacctccaaggaattgatgatggccaccataggaatcgcactcctttcccaaagcaccataccagaaaccattcttgaactgactgatgcattagccctgggcatgatggtcctcaaaatagtgagaaatatggaaaaataccaattggcagtgactgtcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacgatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaagaccgagcataccgggcgggagatcgtggacctaatgtgtcatgccacatttactatgaggctgttatcaccagtcagagtgccaaattacaacctgatcatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgcgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatatggacaaaagaaggggaaaggaaaaagttaaaacccagatggttggatgctaggatctattctgacccactagcactaaaagaattcaaggaatttgcagctggaagaaaatctttgaccctgaacctaatcacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccggacccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaggaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaagcaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcattggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaaccaagtcagatcccttataggcaatgaggaatacacagactacatgccatccatgaagagatttagaagggaagaggaagaggcaggtgtcctgtggtag

SEQ ID NO: 6584 - RNA, 9876 nt, synthetic construct
  misc_feature 1..9876: note = derived and/or modified CDS sequence (wt) from DENV-2__FJ390391__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccatttttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagagccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaaatgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 6585 - RNA, 9876 nt, synthetic construct
  misc_feature 1..9876: note = derived and/or modified CDS sequence (wt) from DENV-2__FJ882593__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggtaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaagaatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaggttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatatccccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagttacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 6586 - RNA, 9876 nt, synthetic construct
  misc_feature 1..9876: note = derived and/or modified CDS sequence (wt) from DENV-2__FJ182014__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctttcctcagacaaaatgaaccagaagacatagattgttggtgcaactctacgtccacatgggtaacttatgggacatgtactaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataataatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagttcaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatttacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 6587 - RNA, 9876 nt, synthetic construct
  misc_feature 1..9876: note = derived and/or modified CDS sequence (wt) from DENV-2__FJ547090__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagttgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcgaccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagactaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgcggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 6588 - RNA, 9876 nt, synthetic construct
  misc_feature 1..9876: note = derived and/or modified CDS sequence (wt) from DENV-2__EU482630__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctttcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttttgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaaaaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagttcaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatttacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 6589 - RNA, 9876 nt, synthetic construct
  misc_feature 1..9876: note = derived and/or modified CDS sequence (wt) from DENV-2__FJ882594__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacaatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaagggtcaaattggatacagaaagagacattggtcactttcaaaaatccccacgcgaagaaacaggatgtcgttgtcttagggtctcaagaaggggccatgcacacggcactcacaggggccacagaaattcagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcattatcacatggataggaatgaattcacgtagcacctcactgtctgtgtcgctagtattggtgggcgttgtgacactgtacctgggagctatggtgcaagctgatagtggttgtgttgtgagctggaaaaataaagaactgaaatgtggcagcgggatcttcatcacagataatgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaagcaggatgtattttgtgactcaaaactcatgtcagcggccattaaagacaacagagccgtccatgctgatatgggttattggatagaaagtgcactcaatgatacatggaagatggagaaagcctccttcatagaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcggcttttaaagttagaccaacttttgcagctggactactcttaagaaaactgacctccaaggaattgatgatggccaccataggaatcgcactcctttcccaaagcaccataccagagaacattcttgaactgactgatgcattagccctgggcatgatggtcctcaagatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtcttaatccaacagccatttttttaacaactctctcgagaaccagcaagaaaaggagctggccgctaaatgaagctatcatggcagttgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacttaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacacttctggcaacagtcacaggaggaatcttcttattcttgatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacattcgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtaactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttcttttttccatcatgaaaaatacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgatcaacagattcacaatgaaacacaagaaagccacttacgagccagatgttgacctaggaagtggaacccgcaacattggaattgaaagtgagataccaaatctagacataataggaaagagaatagagaaaataaaacaagagcatgaagcatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccaaaggaaggcacaaagaaactgatgaaaattacggcagagtggctttggaaagaactaggaaagaaaaagacacctaggatgtgtaccagagaagaattcacaaaaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcagggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtgatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 6590 - RNA, 9876 nt, synthetic construct
  misc_feature 1..9876: note = derived and/or modified CDS sequence (wt) from DENV-2__FJ205885__SS-prME
  source 1..9876: mol_type = other RNA
acagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgccatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagaaccgggacaattgaaactcaattggtttaagaagggaagttccatcggccaaatgtttgagacaacaatgaggggagcaaagagaatggccattttaggtgacacagcctgggactttggatccctgggaggagtgcttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggtatttgtggaatccgctcagtaacaagattggagaatctgatgtggaagcaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacttttcttattgatggccctgaaacagcagaatgccccaacacaaacagagcttggaactcgctggaagttgaagactatggttttggagttttcaccaccaatatatggctgaaattgagagaaaagcaggatgtattttgtgactcaaaactcatgtcagcagccatcaaagacaacagagccgttcatgccgatatgggttattggatagaaagtgcactcaatgacacatggaagatggagaaagcctcctttattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacctttgcagctggactactcttgagaaaactgacttccaaggaattgatgatggccaccataggaatagcactcctttcccaaagcaccataccagagaccattcttgaactgactgatgcgctagccttgggcatgatggtcctcaaaatagtgagaaatatggaaaaataccaactggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagtccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggatctccatccaggagcaggaaagacaaaaagatatcttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggagccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacacagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagtcttgctcattccagaaccagaaaaacagagaacaccccaagacaaccagttgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggatattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttctatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagctagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6591 - RNA, 9876 nt, synthetic construct
  misc_feature 1..9876: note = derived and/or modified CDS sequence (wt) from DENV-2__FJ744743__SS-prME
  source 1..9876: mol_type = other RNA
acagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacaggaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgtggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacgctgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcgttacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcaactcttcttcgttttgtagcacagtatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccatagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6592 - RNA, 9876 nt, synthetic construct
  misc_feature 1..9876: note = derived and/or modified CDS sequence (wt) from DENV-2__JN819424__SS-prME
  source 1..9876: mol_type = other RNA
acagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcgtccagcatagacaacagagccgttcatgccgatatgggttattggatggaaagtgcaccctctgattcatgcaagatggagaaagcctccttcattgaagataaaagctgctactggccaaattcacaacacctgtggagcaatggagtattagaaagtgagatgatattcccaaaaaattttgccgggccagtgtcacaacacatctacagaccaggctaccacacacaaacagcaggaccttgcaatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggaagccattgatggtgaataccgattgagaggggaagcaaggaaaacctttgtggacctaatgagaagaggggacttaccagtcaggttggcctacaaagtggcagctgaaggcatcaattacgcagacagaaagtggtgttttgatggaattaagaacagccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaatcaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacagcaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6593 - RNA, 9876 nt, synthetic construct
  misc_feature 1..9876: note = derived and/or modified CDS sequence (wt) from DENV-2__FJ744741__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttattgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaaacatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacttcactgtctgtgtcgttagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcacgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggagggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgactgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctataaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggagtttgcagctggaagaaaatctttgaccctgaacctaatcacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgccaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaggtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgaaccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacatcttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagatcaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaaaaacatccaaacagcaataaatcaagtcagatcccttataggcaatgaggaatacacagactacatgccatccatgaagagatttagaagggaagaggaagaggcaggtgtcctgtggtag

SEQ ID NO: 6594 - RNA, 9876 nt, synthetic construct
  misc_feature 1..9876: note = derived and/or modified CDS sequence (wt) from DENV-2__FJ744703__SS-prME
  source 1..9876: mol_type = other RNA
acagcaggcgtgattgtgatgttgattccaacagcgatggcgttccatctaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaacggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaatccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattccatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcagggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtgatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 6595 - RNA, 9876 nt, synthetic construct
  misc_feature 1..9876: note = derived and/or modified CDS sequence (wt) from DENV-2__FJ850067__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatataccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttgctgttcacaggacatctcaagtgcaggctgagaatggacaaactacagctcaaaggaatgtcatactccatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggctaccataggaatcgcactcctttcccaaagcaccataccagagaccattctagaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccaccagagtagtggcagctgaaatggaggaagctcttagaggacttccaataagataccaaactacagctatcaaaaccgaacataccgggcgggagatcgtggacctaatgtgtcatgccacatttactatgaggctgttatcaccagtcagagtgccaaattacaacctgatcatcatggacgaagcccactttacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagcataaaagcaggaaatgatatagcagcttgtcttaggaaaaatggaaagaaagtgatacaactcagtaggaagacttttgactctgagtatgttaagactagagccaatgattgggactttgtggtcacgactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataatatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatttattctgacccactggcactaaaagaattcaaggaatttgcagctggaagaaaatctttgaccctgaacctaattacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacacttgtcacaccaatgttgagacacagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataaccctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaccataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatttagtgcgtctgcaaagtggagttgacgttttcttcaccccgccagaaaagtgtgaaacattgttgtgtgacataggggagtcgtcaccaaatcccacgatagaagcaggacgaacactcagagtcctcaacttagtggaaaattggttgaacaataacacccaattctgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacataggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaaattagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacttggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6596 - RNA, 9876 nt, synthetic construct
  misc_feature 1..9876: note = derived and/or modified CDS sequence (wt) from DENV-2__FJ850060__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtattgtatagaagcaaagctgaccaatacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcatgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagataaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggataaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagttacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagactggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacttgggaagagtgatggttatggtgggcgctaccatgacggatgacataggtatgggagtgacttatcttgccctactagcagcttttaaaattagaccaacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcgcaatattggcagcggtgtccgtttcaccactgctcttaacatcctcacagcagaaagcggattggataccactggcattgacgataaaaggtctcaatccaacagccatttttctaacaactctttcgagaaccagcaagaaaaggagctggccgctaaatgaagctgtcatggcagtcgggatggtgagcattttagccagttctctcctaaagaatgatattcccatgacaggtccattagtggctggagggctccttaccgtatgttacgtgctcactggacgatcggccgatttggaactggagagagccgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcttacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctagctcccactagagtagtggcagctgaaatggaggaagctcttagaggacttccaataagataccaaaccccagccatcaaaaccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagatccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggttacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggagcctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaggaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaagcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccttgggaatgtgttgcataatcacagctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtaaggaatccactctcacgaaactccacgcatgaaatgtactgggtatctaatgccaccgggaacatagtgtcatcagtgaacatgatctcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctttcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgccacattgggttccaacaagccgaacaacctggtccatacacgctaagcatgaatggatgacgacggaagacatgctggcagtctggaacagggtgtggatccaaggaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6597 - RNA, 9876 nt, synthetic construct
  misc_feature 1..9876: note = derived and/or modified CDS sequence (wt) from DENV-2__FJ850061__SS-prME
  source 1..9876: mol_type = other RNA
acagcaggcgtgattattatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagacacaatcacgtacaagtgtcctctcctcagacaaaatgaaccagaagacatagattgttggtgcaactctacgtccacatgggtaacttacgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggctttaccataatggcagcaatcctggcatacaccataggaacgacacatttccaaagggccttgattttcatcttactgacagcagtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggttacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgcgacaacaatgagaggagcaaagagaatggccattttaggtgacacagcctgggactttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagtcaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaattgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatttttaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcgcaagtcaagcctataactttcacggcagctcttcttttattggtagcccattatgccattatagggccaggtcttcaagcaaaagcacccagagaagctcagaaaagagcagcagcaggcatcatgaaaaatccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactctacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgaggtaccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattactgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgccacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcttgtggtag

SEQ ID NO: 6598 - RNA, 9876 nt, synthetic construct
  misc_feature 1..9876: note = derived and/or modified CDS sequence (wt) from DENV-2__FJ744709__SS-prME
  source 1..9876: mol_type = other RNA
acagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcagttctggcatacaccataggaacgacacatttccaaaaggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagaaccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaaccagacttttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggtaagcttgagatggactttgatttctgcgaaggaactacagtggtggtaactgaggactgtggaaatagaggaccctctttaaggacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggcctcaatccaacagccatttttctaacaactctttcgagaaccagcaaaaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagtccaatcctgtcaataacaatatcagaagatggcagcatgtcgataaaaaatgaagaggaagaacaaacactgaccatacttatcagaacgggattgttggtgatctcaggaatctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagatatcttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagagttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggagccccttgaaaatgatgaagactgtgcacattggaaagaagccaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacacagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacacctcaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactatgggaaggaaatccagggaggttttggaatactaccattgcagtgtcaatggccaacatctttagggggagctacttggccggagctggacttctcttttctatcatgaaaaacacaacaagcacaagaagaggaactggcaacataggagagacacttggagaaaaatggaaaagtcgattaaacgcactagggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagatcacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaggaaaaagacacccaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagagaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6599 - RNA, 9876 nt, synthetic construct
  misc_feature 1..9876: note = derived and/or modified CDS sequence (wt) from DENV-2__FJ744708__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagctagttctctcctaaagaatgatattcccatgacaggtccattagtggctggagggctccttaccgtatgttatgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcacacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcagagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctagacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcgcaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggtcaacatctttagcgggagctacttggccggagctggactacacgtcccgctccggaaaaacacactccgcacaagaagaggaaccggcaacacaggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 6600 - RNA, 9876 nt, synthetic construct
  misc_feature 1..9876: note = derived and/or modified CDS sequence (wt) from DENV-2__FJ810418__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaaaggaggcatcgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttaagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatggtaatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggcatgggagtgacttatcttgccctactagcagcttttaaagttagaccaacttttgcagctggactactcttgagaaaactgacttccaaggaattgatgatggccaccataggaatagcactcctttctcaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagatacctcccagccatagttagagaagctataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacttaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctctacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccagaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagtagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 6601 - RNA, 9876 nt, synthetic construct
  misc_feature 1..9876: note = derived and/or modified CDS sequence (wt) from DENV-2__FJ639835__SS-prME
  source 1..9876: mol_type = other RNA
acagcaggtgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgccatgtttacatgcaaaaagaacatggaaggaaaagtcgtgcagccagaaaacttggagtacaccatcgtgataacaccacactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctaagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagccatccaaaaagctcatgaagagggcatttgtggaatccgctcagtaacaagattggagaatctgatgtggaaacaaataacaccagaattgaatcatattctatcagaaaatgaggtaaaattgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatggtaatcccaaaaaattttgccgggccagtgtcacaacacaactacagaccaggctaccatacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaattgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagtccaatcctgtcaataacgatatcagaagatggcagcatgtcgataaaaaatgaagaggaagaacaaacactgaccatacttatcagaacgggattgttggtgatctcaggagtctttccagtatcgataccaatcacggcagcagcatggtacctgtgggaagtaaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgatcagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggaaaccctggagacactgcttctactgacactcctggcaacagtcacaggaggaatcttcttattcttaatgagtggaaaaagtatagggaagatgaccctgggaatgtgttgcataatcacggctagcatcctcctatggcatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggatatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtgatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcgacatatgggtggaatctagtgcgtctgcaaagtggagttgacgttttcttcaccccgccggaaaagtgtgacacattgctgtgtgacataggggagtcgtcaccaaaccccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgatcaacagattcacaatgaaacacaagaaagccacttacgagccagatgttgacctaggaagtggaacccgcaacattggaattgaaaatgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggtaatgaggaatacacagattacatgccatccatgaagagattcagaagggaagaggaagaggcaggtgtcctgtggtag

SEQ ID NO: 6602 - RNA, 9876 nt, synthetic construct
  misc_feature 1..9876: note = derived and/or modified CDS sequence (wt) from DENV-2__FJ850050__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacagggggcacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcattacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaatacaacagagccgttcatgccgatatgggttattggatagaaagtgcgccctgtgactcgtgggagatgcagaaagcctccttcattgaagttataagctgccactggccaaagtcactcaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgctcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggaatcaattacgcagacagaaagtggtgttttgatggaattaagaacaaccaaatactggaagaaaatatgcaagagcaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgtttttaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcaggaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 6603 - RNA, 9876 nt, synthetic construct
  misc_feature 1..9876: note = derived and/or modified CDS sequence (wt) from DENV-2__FJ639837__SS-prME
  source 1..9876: mol_type = other RNA
acagcaggtgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgccatgtttacatgcaaaaagaacatggaaggaaaagtcgtgcagccagaaaacttggagtacaccatcgtgataacaccacactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctaagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagccatccaaaaagctcatgaagagggcatttgtggaatccgctcagtaacaagattggagaatctgatgtggaaacaaataacaccagaattgaatcatattctatcagaaaatgaggtaaaattgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatggtaatcccaaaaaattttgccgggccagtgtcacaacacaactacagaccaggctaccatacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagtccaatcctgtcaataacgatatcagaagatggcagcatgtcgataaaaaatgaagaggaagaacaaacactgaccatacttatcagaacgggattgttggtgatctcaggagtctttccagtatcgataccaatcacggcagcagcatggtacctgtgggaagtaaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggaaaccctggagacactgcttctactgacactcctggcaacagtcacaggaggaatcttcttattcttaatgagtggaaaaagtatagggaagatgaccctgggaatgtgttgcataatcacggctagcatcctcctatggcatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggatatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagctccaataccctatgatccaaaatttgaaaagcagttaggacaagtgatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcgacatatgggtggaatctagtgcgtctgcaaagtggagttgacgttttcttcaccccgccggaaaagtgtgacacattgctgtgtgacataggggagtcgtcaccaaaccccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgatcaacagattcacaatgaaacacaagaaagccacttacgagccagatgttgacctaggaagtggaacccgcaacattggaattgaaaatgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtggccaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggtaatgaggaatacacagattacatgccatccatgaagagattcagaagggaagaggaagaggcaggtgtcctgtggtag

SEQ ID NO: 6604 - RNA, 9876 nt, synthetic construct
  misc_feature 1..9876: note = derived and/or modified CDS sequence (wt) from DENV-2__FJ744706__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaacagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccgtgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagggtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggtgccgtatctctagacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacttaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcttggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctctacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggacctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaggcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaactaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 6605 - RNA, 9876 nt, synthetic construct
  misc_feature 1..9876: note = derived and/or modified CDS sequence (wt) from DENV-2__FJ744707__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggatggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaaatactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctggaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagccccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 6606 - RNA, 9876 nt, synthetic construct
  misc_feature 1..9876: note = derived and/or modified CDS sequence (wt) from DENV-2__FJ744704__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgatcttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatcttaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttagaaaaaagacacgtattaggtcgcttgattacagttaacccaatcgtaacagaaaaagatagcccagtcaacatagaagcagaacctccattcggagatagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatttatggggctgcttttagtggggtctcatggactatgaaaatcctcataggagtcatcatcacatggataggaatgaattcacgtagcacctcactgtctgtgtcgctagtattggtgggtgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccctggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttaagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagttgggatggtgagcattttagccagttctctcctaaagaatgatattcccatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatgttcaaaaccaacaccggaaccataggcgccgtatctctggacttttcccctggaacgtcaggatctccaattgtcgacagaaaaggaaaagttgtgggtctttacggtaatggtgttgtcacaagaagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaactgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagggaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggttacaactgacatctcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaagaaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggaaaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacttacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggaatcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatatgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagagaactccctgagtggagtggaaggagaagggctgcacaggctaggctacattttaagagacgtgggcaagaaggaagggggagcaatgtacgccgatgacacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacagcaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaacgccatttgctcggcagtcccgccacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaaaaacatccaaacagcaataaatcaagtcagatcccttataggcaatgaggaatacacagactacatgccatccatgaagagattcagaagggaagaggaagaggcaggtgtcctgtggtag

SEQ ID NO: 6607 - RNA, 9876 nt, synthetic construct
  misc_feature 1..9876: note = derived and/or modified CDS sequence (wt) from DENV-2__FJ744745__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctattcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgaaaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctaggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggactcgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagttgggatggtgagcattttagccagttctctcctaaagaatgatattcccatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccattaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagccagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgagtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtaccctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgcttatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagggaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccagcgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtagtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatagtaggttttgggagctggttgacagggaaagaaatctccatcttgaaggaaagtgtgaaacatgtgtgtacaacatgatgggaaaaagagagaagaaactaggggaattcggcaaggcaaaaggtagcagagccatatggtacatgtggcttggagcacgcttcttagagtttgaagccctaggattcctaaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgtagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgccacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6608 - RNA, 9876 nt, synthetic construct
  misc_feature 1..9876: note = derived and/or modified CDS sequence (wt) from DENV-2__FJ744705__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaaaggaggcattgtgacctgtgctatgtttacatgcaaaaagaacatggaaggaaaagtcgtgcagccagaaaatttggaatacaccatcgtgataacaccccactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacgattctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcattgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagtagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttaagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaatatcaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagttgggatggtgagcattttagccagttctctcctaaagaatgatattcccatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttaccatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcgtgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagagaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaatacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggagagtcgtcaccaaatcctacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgaggagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgccacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6609 - RNA, 9876 nt, synthetic construct
  misc_feature 1..9876: note = derived and/or modified CDS sequence (wt) from DENV-2__FJ744744__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctattcaaaacagaggacggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgaaaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggtgtctcatggactatgaaaatcctcataggagtcatcatcacatggataggaatgaattcacgtagcacctcactgtctgtgtcgctagtattggtgggcgttgtgacactgtacctaggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggactcgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagttggactactcttaagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagtggtgtccgtttcaccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagttgggatggtgagcattttagccagttctctcctaaagaatgatattcccatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagccagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgagtgatcttggcaggacctatgccggtgacccactctagtgcagcgcaaagaagagggagaataggaagaaatccaaaaaatgaaaatgaccagtacatatacatgggggaacctcttgaaaatgatgaaaactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgcttatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccagcgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctaaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgcgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgtagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgccacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6610 - RNA, 9876 nt, synthetic construct
  misc_feature 1..9876: note = derived and/or modified CDS sequence (wt) from DENV-2__GQ868646__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtaggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaaaggaggcattgtgacctgtgctaagtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttatcgatggccctgaaacagcagaatgccccaacacaaacagagcctggaactcgctggaagttgaagactatggttttggagttttcaccaccaatatatggctgaaattgagagataaacaggatgtattttgtgactcaaaactcatgtcagcggccattaaagacaacagagccgttcatgctgatatgggttattggatagaaagtgcactcaatgacacatggaagatggagaaagcctccttcattgaagtcaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtatgggatggaaatcagaccattgaaagagaaagaagagaatttggtcaactccttggtcacagccggacatgggcagattgacaacttttcactaggagtcttgggaatggcactgctcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctgggctactcttaagaaaactgacctccaaggaattgatgatggccaccataggaatcgcactcctttcccaaagcaccataccagaaaccattcttgaactgactgatgcattagccctgggcatgatggtcctcaaaatagtgagaaatatggaaaaataccaattggcagtgactgtcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacgatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgcgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatatggacaaaagaaggggaaaggaaaaagttaaaacccagatggttggatgctaggatctattctgacccactagcactaaaagaattcaaggaatttgcagctggaagaaaatctttgaccctgaacctaatcacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccggacccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaggaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaagcaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaaggaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcattggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaaccaagtcagatcccttataggcaatgaggaatacacagactacatgccatccatgaagagatttagaagggaagaggaagaggcaggtgtcctgtggtag

SEQ ID NO: 6611 - RNA, 9876 nt, synthetic construct
  misc_feature 1..9876: note = derived and/or modified CDS sequence (wt) from DENV-2__FJ906961__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggtattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggacttcggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagcctcacaatcagacctttcttattgatggccctgaaacagcagaatgccccaacacaaacagagcctggaactcgctggaagttgaagactatggttttggagttttcaccaccaatatatggctgaaattgagagaaaaacaggaagtattttgtgactcaaaactcatgtcagcagccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccctggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttctcaaagcaccataccagagaccattcttgaactgactgatgcattagccctgggcatgatggtcctcaaaatagtgagaaacatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttctcctggaacgtcaggatctccaatcgtcgacagaaaaggaaaagttgtgggtctttacggtaatggtgttgtcacaagaagtggagcatatgtaagtgctatagcccagaccgaaaaaagcattgaagacaatccagagatcgaagatgatattttccgaaagaaaagattgaccatcatggacctccatccaggagcaggaaagacaaaaagataccttccagccatagttagagaagccataaaacgtggcttgagaacactgatcctggctcccactagagtagtggcagctgaaatggaggaagctcttagaggacttccaataagataccaaaccacagctatcaaaaccgagcatactgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttagaaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcctggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtagacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgccaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6612 - RNA, 9876 nt, synthetic construct
  misc_feature 1..9876: note = derived and/or modified CDS sequence (wt) from DENV-2__FJ906962__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatctggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgaaacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactatacctgggagctatggtgcaagctgatagtggttgtgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgagataaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcctgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcggcttttaaagttagaccaacttttgcagctggactactcttaagaaaactgacctccaaggaattgatgatggccaccataggaatcgcactcctttcccaaagcaccataccagagaacattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtctcaccactgctcttaacatcctcacagcagaaagcggattggataccactggcattgacgataaaaggtctcaatccaacagccatttttttaacaactctctcgagaaccagcaagaaaaggagctggccgctaaatgaagctatcatggcagttgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaattgtcgacagaaaaggaaaagttgtgggtctttacggaaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacttaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacacctcaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttcttttttccatcatgaaaaacacaacaaacacaagaagaggaactggcaacataggagagacacttggagaaaaatggaaaagtcgattaaacgcactgggaaaaagtgaatttcaaatctataagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttgaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatagaagcccaattaattagacagatggagggagaaggaatcttcaaaagcattcaacacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattggactaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6613 - RNA, 9876 nt, synthetic construct
  misc_feature 1..9876: note = derived and/or modified CDS sequence (wt) from DENV-2__FJ850053__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggtattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggacttcggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagcctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccctggcatctaggtaagcttgagatggactttgatctttgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttctcaaagcaccataccagagaccattcttgaactgactgatgcattagccctgggcatgatggtcctcaaaatagtgagaaacatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgatattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggactcccaataagataccaaaccacagctatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttagaaaaaatggaaagaaagtgatacaactcagtagaaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcctggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtagacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgccaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6614 - RNA, 9876 nt, synthetic construct
  misc_feature 1..9876: note = derived and/or modified CDS sequence (wt) from DENV-2__JN819420__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacagcctgccactctaaggaagtactgcatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaatccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagactggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaaatactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagagagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcggcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatagcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagacctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccatgggatgctattcacaattcaagcctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattgatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 6615 - RNA, 9876 nt, synthetic construct
  misc_feature 1..9876: note = derived and/or modified CDS sequence (wt) from DENV-2__FJ850118__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgcaccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttctatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccacggcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggatatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttaagaaaactgacctccaaggaattgatgatggccaccataggaatcgcactcctttcccaaagcaccataccagagaccattcttgaactgactgatgcgttagccctgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttctaacaactctctcgagaaccagcaagaaaaggagctggccgctaaatgaagctatcatggcagttgggatggtgagcattttagccagttctctcctaaagaatgatattcccatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattagaacctggaaaaaatccaagagccgtccaaacgaaacctggaatattcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttgggaaagtcttacgcccaaatgtggaccctgatgtacttccacagacgtgacctcagactggcggcaaatgccatttgctcggcagtcccgccacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6616 - RNA, 9876 nt, synthetic construct
  misc_feature 1..9876: note = derived and/or modified CDS sequence (wt) from DENV-2__JN819416__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtctcctgttcaaaacagaggatggtgttaacatgtgtaccctcatggccatagaccttggtgaattatgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccaccctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaagattgtgaaggaaatagcagaaacacaacatggaacaatagttatcagagtacaatatgaaggggacggttctccatgtaagatcccttttgagataacagatttggaaaaaagacacgtcttaggtcgcttgattacagtcaacccaatcgtaacagaaaaagatagcccagtcaacatagaagcagaacctccatttggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttctcattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggttaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggattactcttgagaaaactgacctccaaggaattgatgatggccaccataggaatcgcactcctttcccaaagcaccataccagagaccattcttgaactgactgatgcgctagccttgggcatgatggtcctcaaaatagtgagaaatatggaaaaataccaattggcagtgactatcatggctatttcgtgcgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcaaattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgatcagtacatatacatgggggaacctcttgaaaatgatgaagactgtgcacattggaaagaagctaaaatgctcctagataacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaataaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatagtaggttttgggagctggttgacagggaaagaaatctccatcttgaaggaaagtgtgaaacatgtgtgtacaacatgatgggaaaaagagagaagaaattaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcactaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacatcattttcatgagttagtcatgaaagatggtcgcgtgctcgtagtcccatgcagaaaccaagatgaactaattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgccacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 6617 - RNA, 9876 nt, synthetic construct
  misc_feature 1..9876: note = derived and/or modified CDS sequence (wt) from DENV-2__FJ850119__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagcctcctgttcaaaacagaggatggtattaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgatgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatctccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttctcattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccactagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctggataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagcctcagaagaaaccgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgccacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6618 - RNA, 9876 nt, synthetic construct
  misc_feature 1..9876: note = derived and/or modified CDS sequence (wt) from DENV-2__FJ850064__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagacacaatcacgtacaagtgtcctctcctcagacaaaatgaaccagaagacatagattgttggtgcaactctacgtccacatgggtaacttacgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggctttaccataatggcagcaatcctggcatacaccataggaacgacacatttccaaagggccttgattttcatcttactgacagcagtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggttacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgcgacaacaatgagaggagcaaagagaatggccattttaggtgacacagcctgggactttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagtcaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaattgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtctcgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactctacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgaggtaccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattactgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgccacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcttgtggtag

SEQ ID NO: 6619 - RNA, 9876 nt, synthetic construct
  misc_feature 1..9876: note = derived and/or modified CDS sequence (wt) from DENV-2__FJ850065__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatttcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtacagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaacgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggttaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggtttgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagaagacattttccgaaagaaaagattgaccatcatggacctccatccaggagcaggaaagacaaaaagataccttccagccatagttagagaagccattaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttccacagagcaatgcaccaatcatggatgaggaaagagaaatccctgagcgttcgtggaattcaggacacgaatgggtcacggattttaagggaaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacattggatagcagcttcaataatactggagttttttctcatagttttgctcattccagaaccagaaaaacagagaacaccccaagacaaccaattgacctacgttgtcatagccatcctcacagtagtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcggcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaacatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggatgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaatcacatgaaaggagaacacaagaaactagccgaggctatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagagatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatctcccagggagctgggtggtctttgaaggagacggcctgtttggggaagtcttacgcccaaatgtggaccctgatgtacttccacagacgtgacctcagactggcggcaaatgccatttgctcggcagtcccgccacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6620 - RNA, 9876 nt, synthetic construct
  misc_feature 1..9876: note = derived and/or modified CDS sequence (wt) from DENV-2__FJ873808__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtattgtatagaagcaaagctgaccaatacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcatgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagataaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggataaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagttacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagactggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacttgggaagagtgatggttatggtgggcgctaccatgacggatgacataggtatgggagtgacttatcttgccctactagcagcttttaaaattagaccaacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcgcaatattggcagcggtgtccgtttcaccactgctcttaacatcctcaaagcagaaagcggattggataccactggcattgacgataaaaggtctcaatccaacagccatttttctaacaactctttcgagaaccagcaagaaaaggagctggccgctaaatgaagctgtcatggcagtcgggatggtgagcattttagccagttctctcctaaagaatgatattcccatgacaggtccattagtggctggagggctccttaccgtatgttacgtgctcactggacgatcggccgatttggaactggagagagccgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctagctcccactagagtagtggcagctgaaatggaggaagctcttagaggacttccaataagataccaaaccccagccatcaaaaccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagatccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggttacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggagcctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaggaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaagcttccaactttcatgactcagaaagcaagaaacgcactggacaacttggctgtgctgcatacggctgaggcaggtggaagggcgtacaatcatgctctcagtgaattgccggagaccctggagacactgcttctactgacactcctggcaacagtcacaggaggaatcttcttattcttaatgagcggaaaaggtatagggaagatgaccttgggaatgtgttgcataatcacagctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaacgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtccttaacccatatatgccttcagtcatagaaaaaatggaagcattacaaaggaaatatggaggagccttagtaaggaatccactctcacgaaactccacgcatgaaatgtactgggtatctaatgccaccgggaacatagtgtcatcagtgaacatgatctcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctttcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgccacattgggttccaacaagccgaacaacctggtccatacacgctaagcatgaatggatgacgacggaagacatgctggcagtctggaacagggtgtggatccaaggaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6621 - RNA, 9876 nt, synthetic construct
  misc_feature 1..9876: note = derived and/or modified CDS sequence (wt) from DENV-2__FJ850120__SS-prME
  source 1..9876: mol_type = other RNA
acagcaggcgtgattgttatgttgattccaacagcgatggcgttccatttaaccacacgcaatggagaaccacacatgatcgttggcaggcaggagaaagggaaaagtcttctgttcaaaacagaggatggtgttaacatgtgtaccctcatggccatagaccttggtgaattgtgtgaggatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccgtcacagaagcagaactgacaggctatggcactgtcacaatggagtgctccccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacattatcataggagtagagccgggacaattgaaactcaattggtttaagaagggaagttccatcggtcaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccatcatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctgtggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggttacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttaagaaaactgacctccaaggaattgatgatggccaccataggaattgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcagtgtccgtttcaccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagttgggatggtgagcattttagccagttctctcctaaagaatgatattcccatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagacggcagcatgtcgataaaaaatgaagaggaagaacaaacgctgaccatactcatcagaacgggattgttggtgatctcaggagtctttccagtatcgataccaattacggcagcagcatggtacctgtgggaagtgaagaaacaacgggctggagtgttgtgggacgtcccttcacccccaccagtggaaaaagccaaactggaggatggagcctacagaatcaagcaaagggggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaaacattgaagacaatccagagatcgaagatgacattttccgaaagaaaagattgaccattatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgagtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccactgtcaaagatggacattggagttcctctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgtgtgactcaagtattaatgatgaggactacatgggctttgtgtgaggctctaaccctagcgaccgggcccatctccacactgtgggaaggaaacccagggaggttttggaacactaccattgcagtgtcaatggctaacatctttagggggagctacttggccggagctggacttctcttttccatcatgaaaaacacaacaaacacaagaagaggaactggcagcataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaaatgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggtacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatagtaggttttgggagctggttgacagggaaagaaacctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccatatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgactgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgtagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6622 - RNA, 9876 nt, synthetic construct
  misc_feature 1..9876: note = derived and/or modified CDS sequence (wt) from DENV-2__FJ850121__SS-prME
  source 1..9876: mol_type = other RNA
acagcaggcgtgattgttatgttgattccaacagcgatggcgttccatttaaccacacgcaatggagaaccacacatgatcgttggtagacaggagaaagggaaaagtcttctgttcaaaacagaggatggtgttaacatgtgtaccctcatggccatagaccttggtgaattgtgtgaagatacaatcacgtacaagtgccctctcctcagacaaaatgaaccagaagacatagattgttggtgcaactctacgtccacatgggtaacttacgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagcagtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttattgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgaaataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgaaacaacaatgagaggagcaaagagaatggccattttaggtgacacagcctgggactttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagtcaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgtaacactgctagttgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgcttttaacatcctcacagcagaaagcggattggataccactggcattgacgataaaaggtctcaatccaacagccatttttctaacaactctttcgagaaccagcaagaaaaggagctggccgctaaatgaggctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagctactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctatgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgactaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtaaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgccacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagtagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6623 - RNA, 9876 nt, synthetic construct
  misc_feature 1..9876: note = derived and/or modified CDS sequence (wt) from DENV-2__GQ199897__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtctcctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttacgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagcagtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacactggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttcttatagatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagtcaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccttctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgccaccatgacggatgacataggtatgggagtgacttatcttgccctactagcagcttttaaagttagaccaacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtggtctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgagggaatcatccctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaatcaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccgttgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgactaaacgcactgggaaaaagtgaatttcaaatctacaagaaaagtggaatccaggaagtggatagaaccctagcaaaagaaggtatcaaaagaggagaaacggaccaccatgccgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaatcacatgaaaggagaacacaagaaactagccgaggccatattcaaattaacgtaccaaaacaaggtggtgcgtgtgcaaagaccaacaccaagaggcacagtaatggacatcatatcgagaagagaccaaagaggcagtgggcaagtcggcacctatggccttaacactttcaccaatatggaagcccaattaattagacagatggagggagaaggaatcttcaaaagtattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgccacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6624 - RNA, 9876 nt, synthetic construct
  misc_feature 1..9876: note = derived and/or modified CDS sequence (wt) from DENV-2__GQ199895__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgttggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggttaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatcgcactcctttcccaaagcaccataccagagaccattcttgaactgactgatgcgttagctttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagaagacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggatttttatgacagccactcctccgggaagtagagacccatttccacagagcaatgcaccaatcatggatgaggaaagagaaatccctgagcgttcgtggaattcaggacacgaatgggtcacggattttaagggaaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcggcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggatgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaatcacatgaaaggagaacacaagaaactagccgaggctatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgccacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 6625 - RNA, 9876 nt, synthetic construct
  misc_feature 1..9876: note = derived and/or modified CDS sequence (wt) from DENV-2__FJ898478__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcggaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcagacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacctactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctttcgagaaccagcaagaaaaggagctggccgctaaatgaagctatcatggcagtcgggatggtgagcattttagccagttctctcctaaagaatgatattcccatgacaggtccattggtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggatgtcccttcacccccaccagtggaaaaagccgaactggaggatggagcctacagaatcaagcaaagagggattcttggatattctcagataggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgccaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacataccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6626 - RNA, 9876 nt, synthetic construct
  misc_feature 1..9876: note = derived and/or modified CDS sequence (wt) from DENV-2__GQ199869__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacatacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacataagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcacgagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 6627 - RNA, 9876 nt, synthetic construct
  misc_feature 1..9876: note = derived and/or modified CDS sequence (wt) from DENV-2__JX079688__SS-prME
  source 1..9876: mol_type = other RNA
acagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaaaggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacttaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggcatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctctacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccagaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcattgaggaatacacagactacatgccatccatgaagagattcagaagggaagaggaagaggcaggtgtcctgtggtag

SEQ ID NO: 6628 - RNA, 9876 nt, synthetic construct
  misc_feature 1..9876: note = derived and/or modified CDS sequence (wt) from DENV-2__JF357906__SS-prME
  source 1..9876: mol_type = other RNA
acagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcagttctggcatacaccataggaacgacacatttccaaaaggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagaaccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaaccagacttttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggtaagcttgagatggactttgatttctgcgaaggaactacagtggtggtaactgaggactgtggaaatagaggaccctctttaaggacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggcctcaatccaacagccatttttctaacaactctttcgagaaccagcaaaaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagtccaatcctgtcaataacaatatcagaagatggcagcatgtcgataaaaaatgaagaggaagaacaaacactgaccatacttatcagaacgggattgttggtgatctcaggaatctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagatatcttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagagttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggagccccttgaaaatgatgaagactgtgcacattggaaagaagccaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacacagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacacctcaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactatgggaaggaaatccagggaggttttggaatactaccattgcagtgtcaatggccaacatctttagggggagctacttggccggagctggacttctcttttctatcatgaaaaacacaacaagcacaagaagaggaactggcaacataggagagacacttggagaaaaatggaaaagtcgattaaacgcactagggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagatcacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaggaaaaagacacccaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagagaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtacatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6629 - RNA, 9873 nt, synthetic construct
  misc_feature 1..9873: note = derived and/or modified CDS sequence (wt) from DENV-2__HQ705624__SS-prME
  source 1..9873: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtaggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaaaggaggcattgtgacctgtgctaagtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctaagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaaggtcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaacaaagaactgaaatgtggcagcgggatcttcatcacagataacgtacacacatggacagaacaatataagttccaaccagaatccccttcaaaactagcttcagctatcaaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttatcgatggccctgaaacagcagaatgccccaacacaaacagagcctggaactcgctggaagttgaagactatggttttggagttttcaccaccaatatatggctgaaattgagagataaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtagtgactgaggactgtggaaatagaggaccctctttaagaacgaccactgcctctggaaaactcataacagaatggtgctgccgatcctgcacactaccacctctaagatacagaggtgaggatggatgctggtatgggatggaaatcagaccattgaaagagaaagaagagaatttggtcaactccttggtcacagccggacatgggcagattgacaacttttcactaggagtcttgggaatggcactgctcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctgggctactcttaagaaaactgacctccaaggaattgatgatggccaccataggaatcgcactcctttcccaaagcaccataccagaaaccattcttgaactgactgatgcattagccctgggcatgatggtcctcaaaatagtgagaaatatggaaaaataccaattggcagtgactgtcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttagaaaaaatggaaagaaagtgatacaactcagcaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgcgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacttttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatatggacaaaagaaggggaaaggaaaaagttaaaacccagatggttggatgctaggatctattctgacccactagcactaaaagaattcaaggaatttgcagctggaagaaaatctttgaccctgaacctaatcacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccggacccatctccacactgtgggaaggaaatccagggaggttttggaacactaccattgcagtgtcaatggctaacatctttagggggagctacttggccggagctggacttctcttttccattatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaggaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataatacccaattttgcataaaggtcctcaacccatatatgccttcagtcatagaaaaaatggaagcattacaaaggaaatacggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaagcaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcattggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacaaaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaaccaagtcagatcccttataggcaatgaggaatacacagactacatgccatccatgaagagatttagaagggaagaggaagaggcaggtgtcctgtggtag

SEQ ID NO: 6630 - RNA, 9876 nt, synthetic construct
  misc_feature 1..9876: note = derived and/or modified CDS sequence (wt) from DENV-2__HQ705625__SS-prME
  source 1..9876: mol_type = other RNA
acagcaggcgtgattgtgatgttgattccaacagcgatggcgtttcatttaaccacacgcaatggagaaccacacatgatcgttggtaggcaggaaaaagggaaaagtcttctgttcaaaacagaggatggtgttaacatgtgtacccttatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaacagagacttcgtagaaggagtttcaggaggaagctgggttgacatagtcttagaacatggaagttgtgtgacgacgatggcaaaaaacaaaccaacattggattttgaactgatgaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttctatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagtaaaaagctgccactggccaaagtcacacaccctttggagcaatggagtattggaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactatttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccgttagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggactcccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagccaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaactaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggctcccaactttcatgactcagaaagcaagaaacgcactggacaacttggctgtgctgcatacggctgaggcaggtggaagggcgtacaatcatgctctcagtgaactgccggagaccctagagacactgcttctactgacactcctggcaacagtcacaggaggaatcttcttattcttaatgagtggaaaaggtatagggaagatgaccctgggaatgtgttgcataatcacggccagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccccataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggcataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcctacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtataacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 6631 - RNA, 9876 nt, synthetic construct
  misc_feature 1..9876: note = derived and/or modified CDS sequence (wt) from DENV-2__JF730052__SS-prME
  source 1..9876: mol_type = other RNA
acagcaggcgtgattgtgatgttgattccaacagcgatggcgtttcatttaaccacacgcaatggagaaccacacatgatcgttggtaggcaggaaaaagggaaaagtcttctgttcaaaacagaggatggtgttaacatgtgtacccttatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaacagagacttcgtagaaggagtttcaggaggaagctgggttgacatagtcttagaacatggaagttgtgtgacgacgatggcaaaaaacaaaccaacattggattttgaactgatgaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttctatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattggaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactatttctggaagaaatgctcaggacccgaataggaacgaaacatgcaatactgctagttgcagtatcttttgtgacactgacaactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccgttagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggactcccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaactaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggctcccaactttcatgactcagaaagcaagaaacgcactggacaacttggctgtgctgcatacggctgaggcaggtggaagggcgtacaatcatgctctcagtgaactgccggagaccctagagacactgcttctactgacactcctggcaacagtcacaggaggaatcttcttattcttaatgagtggaaaaggtatagggaagatgaccctgggaatgtgttgcataatcacggccagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccccataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggcataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcctacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtataacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 6632 - RNA, 9876 nt, synthetic construct
  misc_feature 1..9876: note = derived and/or modified CDS sequence (wt) from DENV-2__EU482748__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagagacaatcacgtacaagtgtcctctcctcagacaaaatgaaccagaagacatagattgttggtgcaactctacgtccacatgggtaacttatgggacatgtaccaccacaggagaacatagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcgaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggaatacaccatcgtgataacaccccactcaggagaagagcacgctgtaggtaatgacacaggaaagcatggcaaagaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgatcacagttaacccaatcgtaacagaaaaagatagcccagtcaacatagaagcagaacctccattcggagacagctatatcatcataggagtagagccgggacaattgaaactcaattggtttaagaagggaagttctatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgtagtgagttggaaaaataaagaactgaaatgtggcagcgggatcttcatcacagataacgtacacacatggacagaacaatataagtttcaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgaactgaagtactcatggaaaacatggggaaaggcgaaaatgctctccacagagtctcacaatcagacctttcttattgatggccctgagacagcagaatgccccaacacaaacagagcttggaattcgctggaagttgaagactatggttttggagttttcaccaccaatatatggctgaaattgagagaaaaacaggatgtattttgtgattcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtaactgaggactgtggaaatagaggaccctctttgagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgaataggaacgaaacatgcaatactgctagttgcagtatcttttgtgacattgataactgggaacatgtcttttagagacctgggaagagtgatggttatggtgggcgctaccatgacggatgacataggtatgggagtgacttatcttgccctactagcagcttttaaagttagaccgacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagccggagtctacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacatcttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcccccgggaagtagagacccatttcctcagagcaatgcaccaatcatggatgaggaaagagaaatccctgagcgttcgtggaattcaggacacgaatgggtcacggattttaaagggaagactgtttggtttgttccaagtataaaagcaggaaatgatatagcagcttgtcttaggaaaaatggaaagaaagtgatacaactcagtaggaagacctttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaacgaaaatgaccagtacatatacatgggggaacctcttgaaaatgatgaagactgtgcacattggaaagaagctaaaatgctcctagataacatcaatacacccgaaggaatcattcctagtatgttcgaaccagagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgacccagaaagcaagaaacgcactggacaacttggctgtgctgcatacggctgaggcaggtggaagggcgtacaatcatgctctcagtgaactgccggagaccctggagacactgcttttactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgccaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccattatgaaaaacacaacaagcacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgatgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgatcaacagattcacaatgaaacacaagaaaaccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaatcttcaaaagcattcagcacctgacagccacagaagaaattgttgtacagaattggttggcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6633 - RNA, 9876 nt, synthetic construct
  misc_feature 1..9876: note = derived and/or modified CDS sequence (wt) from DENV-2__EU482749__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagacaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaagtgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttaggttctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtcttaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaattacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaactaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccagttttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaaattagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6634 - RNA, 9876 nt, synthetic construct
  misc_feature 1..9876: note = derived and/or modified CDS sequence (wt) from DENV-2__EU482751__SS-prME
  source 1..9876: mol_type = other RNA
acagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatttctgcgaaggaaccacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaagggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaagcagcaataaatcaagtcagatcccttataggcaatgaggaatacacagactacatgccatccatgaagagattcagaagggaagaggaagaggcaggtgtcctgtggtag

SEQ ID NO: 6635 - RNA, 9876 nt, synthetic construct
  misc_feature 1..9876: note = derived and/or modified CDS sequence (wt) from DENV-2__GQ868604__SS-prME
  source 1..9876: mol_type = other RNA
acagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaattacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacgtgggcagattgacaacttttcactaggagtcctgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcggcttttaaagttagaccaacttttgcagctggactactcttaagaaaactgacctccaaggaattgatgatggccaccataggaatcgcactcctttcccaaagcaccataccagagaacattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtggagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacttaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacacttctggcaacagtcacaggaggaatcttcttattcttaatgagcggaaaaggtatagggaagatgaccctgggaatgtgttgcataattacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctataagaaaagtggaatccaggaagtggatagaaccctagcaaaagaaggtataaaaagaggagaaacggaccaccatgctgtgtcgcgaggttcagcaaaactgaggtggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaagagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6636 - RNA, 9876 nt, synthetic construct
  misc_feature 1..9876: note = derived and/or modified CDS sequence (wt) from DENV-2__EU482752__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagatagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgtgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaagcaggatgtattttgtgactcaaaactcatgtcagcggccattaaagacaacagagccgttcatgctgatatgggttattggatagaaagtgcactcaatgatacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcggcttttaaagttagaccaacttttgcagctggactactcttaagaaaactgacctccaaggaattgatgatggccaccataggaatcgcactcctttcccaaagcaccataccagagaacattcttgaactgactgatgcattagccctgggcatgatggtcctcaagatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgagaaccagcaagaaaaggagctggccgctaaatgaagctatcatggcagttgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagggacccatttcctcagagcaatgcaccaatcatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacttaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttcttttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttgaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcaacacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6637 - RNA, 9876 nt, synthetic construct
  misc_feature 1..9876: note = derived and/or modified CDS sequence (wt) from DENV-2__EU482753__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgttacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatacggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctagaatctattctgacccactggcactaaaagaattcaaggaatttgcagctggaagaaaatctttgaccctgaacctaatcacagaaatgggtaggcttccaactttcatgactcagaaagcaagaaacgcactggacaacctggctgtgctgcatacggctgaggcaggtggaagggcgtacaatcatgctctcagtgaactgccggagaccttggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaatgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaatggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcaatgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6638 - RNA, 9876 nt, synthetic construct
  misc_feature 1..9876: note = derived and/or modified CDS sequence (wt) from DENV-2__EU482680__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacggactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaaatcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtacgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcgagaaacgcactggacaacttggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgactaaacgcattggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcagagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagaaaccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagctgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6639 - RNA, 9876 nt, synthetic construct
  misc_feature 1..9876: note = derived and/or modified CDS sequence (wt) from DENV-2__EU482754__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatggaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtactggtgggcgttgtgacactgtacctgggagctatggtgcaagctgatagtggttgcgttgtgagctggaaaaataaagaactgaaatgtggcagcgggatcttcatcacagataacatacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttaaccattatgacaggagacatcagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggctattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagctgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccggagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacatgggcttaccatggcagctatgaaacaaaacaaactggatcagcatcatctatggtgaacggagtggtcagattgctgacaaaaccctgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggcctcaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgactgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagttagatcccttataggcaatgaggaatacacagactacatgccatccatgaagagatttagaagggaagaggaagaggcaggtgtcctgtggtag

SEQ ID NO: 6640 - RNA, 9876 nt, synthetic construct
  misc_feature 1..9876: note = derived and/or modified CDS sequence (wt) from DENV-2__FJ478455__SS-prME
  source 1..9876: mol_type = other RNA
acagcaggcgtgattgtgatgttgattccaacagcgatggcgttccatttaaccacacgcaatggggaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagtagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaagcagcaataaatcaagtcagatcccttataggcaatgaggaatacacagactacatgccatccatgaagagattcagaagggaagaggaagaggcaggtgtcctgtggtag

SEQ ID NO: 6641 - RNA, 9876 nt, synthetic construct
  misc_feature 1..9876: note = derived and/or modified CDS sequence (wt) from DENV-2__EU482756__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtaggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaatatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacctgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactagcactaaaagaattcaaggaatttgcagctggaagaaaatctttgaccctgaacctaatcacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtagctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggggcaatgtacgccgatgatacagcaggatgggacacaagaatcacactagaagacttaaaaaatgaagaaatggtaacgaaccacatgaaaggagaacacaagaaactagccgaggccatattcaaactaacgtaccaaaacaaggtggtgcgtgtgcaaagaccaacaccaagaggtacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6642 - RNA, 9876 nt, synthetic construct
  misc_feature 1..9876: note = derived and/or modified CDS sequence (wt) from DENV-2__EU482757__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacatagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcgaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggaatacaccatcgtgataacaccccactcaggagaagagcacgctgtaggtaatgacacaggaaagcatggcaaagaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggtttctagacctgccgttaccatggctacccggagcagacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgatcacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgtagtgagttggaaaaataaagaactgaaatgtggcagcgggatcttcatcacagataacgtacacacatggacagaacaatataagtttcaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgaactgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttcaccaccaatatatggctgaaattgagagaaaaacaggatgtattttgtgattcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtaactgaggactgtggaaatagaggaccctctttgagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgaataggaacgaaacatgcaatactgttagttgcagtatcttttgtgacattgataactgggaacatgtcttttagagacctgggaagagtgatggttatggtgggcgctaccatgacggatgacataggtatgggagtgacttatcttgccctactagcagcttttaaagttagaccgacttttgcagctggactactcttgagaaaattgacctccaaggaattgatgatggccactataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagccggagtctacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacatcttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcccccgggaagtagagacccatttcctcagagcaatgcaccaatcatggatgaggaaagagaaatccctgagcgttcgtggaattcaggacacgaatgggtcacggattttaaagggaagactgtttggtttgttccaagtataaaagcaggaaatgatatagcagcttgtcttaggaaaaatggaaagaaagtgatacaactcagtaggaagacctttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaacgaaaatgaccagtacatatacatgggggaacctcttgaaaatgatgaagactgtgcacattggaaagaagctaaaatgctcctagataacatcaatacacccgaaggaatcattcctagtatgttcgaaccagagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagatagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgacccagaaagcaagaaacgcactggacaacttggctgtgctacatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctactacatttgtcacaccaatgttgagacatagcattgaaaattcctcagtgaatgtctccctaacagccattgccaatcaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccattatgaaaaacacaacaagtacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgatgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgatcaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccgtacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagtttggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaatcttcaaaagcattcagcacctgacagccacagaagaaattgttgtacagaactggttggcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagtagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6643 - RNA, 9876 nt, synthetic construct
  misc_feature 1..9876: note = derived and/or modified CDS sequence (wt) from DENV-2__FJ906956__SS-prME
  source 1..9876: mol_type = other RNA
acagcaggcgtgattgttatgttgattccaacagcgatggcgttccatttaaccacacgcaatggagaaccacacatgatcgttggtaagcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacaggaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatccttataggagtcatcatcacatggataggaatgaattcacgtagcacctcactgtctgtgtcgctagtattggtgggcgttgtgacactgtacctgggagccatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatggtaatcccaaaaaattttgccgggccagtgtcacaacacaactacagaccaggctaccatacacaaacagcaggaccttggcatctaggcaagcttgagatggactttgatctctgcgaaggaactacagtggtggtgactgaggactgtgggaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcaagaaccagtaagaaaaggagctggccgctaaatgaagctatcatggcagttgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactatgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggatttttatgacagccactcctccgggaagtagagacccatttcctcagagcaatgcaccaatcatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagagagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcattggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagagccagaaaaacagagaacaccccaagacaaccaattgacctacgttgtcatagccatcctcacagtggtggccgcaactatggcaaacgagatgggtttcctggaaaaaaccaagaaagacctcggattgggaagcattacaacccaggaatctgagagcaatatcctggatatagatctacgccctgcatcagcatggacgctgtatgccgtggctacaacatttgtcacaccaatgttgagacatagcattgaaaattcttcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaggagacggcctgtttgggaaagtcttacgcccaaatgtggactctgatgtacttccacagacgtgacctcagactggcggcaaatgccatttgctcggcagtcccgtcacactgggttccaacaagtcgaacaacctggtccatacacgctaaccatgaatggatgacgacggaagacatgctggcagtctggaacagggtgtggatccaagaaaacccgtggatggaagacaaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6644 - RNA, 9876 nt, synthetic construct
  misc_feature 1..9876: note = derived and/or modified CDS sequence (wt) from DENV-2__EU482759__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgcaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcctagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagaggagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacatttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatcttcatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgtgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgctatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacattcaaacagcaataaatcaagtcagatcccttataggcaatgaggaatacacagactacatgccatccatgaagagatttagaagggaagaggaagaggcaggtgtcctgtggtag

SEQ ID NO: 6645 - RNA, 9876 nt, synthetic construct
  misc_feature 1..9876: note = derived and/or modified CDS sequence (wt) from DENV-2__EU482760__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtgccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaattacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatattggagttttttcttatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccctgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaaattagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6646 - RNA, 9876 nt, synthetic construct
  misc_feature 1..9876: note = derived and/or modified CDS sequence (wt) from DENV-2__EU482762__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattgtttggaaagggaggcattgtgacctgtgctatgtttacatgcaaaaagaatatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagttgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttactggatagaaagtgcactcaatgacacatggaagatggagaaagcctccttcattgaagttaaaagctgctactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgagaaccagcaagaaaaggagctggccgctaaatgaagctatcatggcagttgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtaatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgctacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacattaacacacccgaaggaatcattcctagtatgttcgaaccagagcgtgaaaaagtggatgccattgatggtgaataccgtttgagaggagaagcaaggaaaacctttgtggacctaatgagaagaggggacttgccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccttgaacctaatcacagaaatgggtaggcttccaactttcatgactcagaaagcaagaaacgcactggacaacttggctgtgctgcacacggctgaggcaggtggaagggcgtacaatcatgctctcagtgaactgccggagaccctggagacactgcttctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaacgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgcttgtagtcccatgcagaaaccaagatgaacttattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6647 - RNA, 9876 nt, synthetic construct
  misc_feature 1..9876: note = derived and/or modified CDS sequence (wt) from DENV-2__EU482763__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatggaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagtcatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagtttttggagcaatctatggggctgcttttagtggggtctcatggactatgaaaatcctcataggagtcatcatcacatggataggaatgaattcacgtagcacctcactgtctgtttcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacatcagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggctattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgcttaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtagctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttacaatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacacagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaatgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaatacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccctgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggagagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagttagatcccttataggcaatgaggaatacacagactacatgccatccatgaagagatttagaagggaagaggaagaggcaggtgtcctgtggtag

SEQ ID NO: 6648 - RNA, 9876 nt, synthetic construct
  misc_feature 1..9876: note = derived and/or modified CDS sequence (wt) from DENV-2__EU482444__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatggaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcttcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattaaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtactggtgggcgttgtgacactgtacctgggagctatggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacatcagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggctattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagctgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggatttttatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaatccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccctgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagtaatgtacgccgatgatacagcaggatgggacacaagaatcacactagaagacttaaaaaatgaagaattggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggcctcaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgtagtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgtggctcattgattgggctaacaagcagggctacctgggcaaagaacatccaaacagcaataaatcaagttagatcccttataggcaatgaggaatacacagactacatgccatccatgaagagatttagaagggaagaggaagaggcaggtgtcctgtggtag

SEQ ID NO: 6649 - RNA, 9876 nt, synthetic construct
  misc_feature 1..9876: note = derived and/or modified CDS sequence (wt) from DENV-2__EU482684__SS-prME
  source 1..9876: mol_type = other RNA
acagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcaacaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggcaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatatagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggggctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggtagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaataaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6650 - RNA, 9876 nt, synthetic construct
  misc_feature 1..9876: note = derived and/or modified CDS sequence (wt) from DENV-2__EU482685__SS-prME
  source 1..9876: mol_type = other RNA
acagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaattacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggaaatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtggagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagacaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaagagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6651 - RNA, 9876 nt, synthetic construct
  misc_feature 1..9876: note = derived and/or modified CDS sequence (wt) from DENV-2__EU482687__SS-prME
  source 1..9876: mol_type = other RNA
acagcaggcgtgattgtgatgctgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcagtcctggcatacaccataggaacgacacatttccaaagggccttgattttcgtcttactgacagctgtcgctccttcaatgacaatgcgctgcatagggatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaaaggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaagaattttgccgggccagtgtcacaacacaactacagaccaggctaccatacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtaatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacccggaaaaaatccaagagccgttcaaacgaaacctggaattttcaaaaccaacactggaaccataggcgccgtatctctggacttttcccctggaacatcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactagagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaagggaagactgtttggtttgttccaagtataaaagcaggaaatgatatagcagcttgtcttaggaaaaatggaaagaaagtgatacaactcagtaggaagacttttgactctgagtatgttaagactagagctaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaacacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggcctggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaatgaaacaagagcatgaaatatcatggcactatgatcaagaccacccatacaaaacgtgggcttaccatggcagctatgaaacaaaacaaactggatcagcatcgtctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctctggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaagcagcaataaatcaagtcagatcccttataggcaatgaggaatatacagactacatgccatccatgaagagattcagaagggaagaggaagaggcaggtgtcctgtggtag

SEQ ID NO: 6652 - RNA, 9876 nt, synthetic construct
  misc_feature 1..9876: note = derived and/or modified CDS sequence (wt) from DENV-2__EU482688__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaatagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtagtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatctcttgtgacattgattactgggaacatgtcttttagagacctgggaagagtgatggttatggtgggcgctaccatgacggatgacataggtatgggagtgacttatcttgccctactagcagcttttaaggttagaccaacttttgcagccggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatacggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggattttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgtgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggaattgacgttttcttcaccccgccagaaaagtgtgatacattgttgtgtgacataggggagtcgtcaccaaaccccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgaccccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaagtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcaatgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6653 - RNA, 9876 nt, synthetic construct
  misc_feature 1..9876: note = derived and/or modified CDS sequence (wt) from DENV-2__EU482691__SS-prME
  source 1..9876: mol_type = other RNA
acagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagaaccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacttttcttattgatggccctgaaacagcagaatgccccaacataaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacataccctttggagcaatggagtattagaaagtgagatgataatcccaaaaaattttgccgggccagtgtcacaacacaactacagaccaggctaccacacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaagatgggaagatcaggcagaaatatcaggaagcagtccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagatatcttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagagttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggagccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacacagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgacacagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttctatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcgtaaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacccaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtgggccgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6654 - RNA, 9876 nt, synthetic construct
  misc_feature 1..9876: note = derived and/or modified CDS sequence (wt) from DENV-2__EU482693__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgcaccctcatggccatagaccttggtgaattgtgtgaagatacaatcacgtacaagtgtcctctcctcagacaaaatgaaccagaagacatagattgttggtgcaactctacgtccacatgggtaacttatgggacatgcaccaccacaggagaacatagaagagaaaaaagatcagtggcgctcgttccacatgtgggtatgggactggagacacgaactgagacatggatgtcatcagaaggggcctggaaacatgttcagagaatcgaaacctggatcttgagacatccaggctttaccataatggcagcaatcctggcatacaccataggaacgacacatttccaaagggccttgattttcatcttactaacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcgaagctgaccaacacaacaacagaatcacgctgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggaatacaccatcgtgataacaccccactcaggagaagagcacgctgtaggtaatgacacaggaaagcatggcaaagaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcatacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgatcacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgtagtgagttggaaaaataaagaactgaaatgcggcagcgggatcttcatcacagataacgtacacacatggacagaacaatataagtttcaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgaactgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttcaccaccaatatatggctgaaattgagagaaaaacaggatgtattttgtgattcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtaactgaggactgtggaaatagaggaccctctttgagaacgaccactgcctctggaaaactcataacagaatggtgctgccgatcctgcacactaccacctctaagatacagaggtgaggatggatgctggtacgggatggaaattagaccattgaaagagaaagaggagaatttggtcaattccttggtcacagccggacatgggcagattgacaacttttcactaggagtcttgggaatggcactgttcctggaagaaatgctcaggacccgaataggaacgaaacatgcaacactactagttgcagtatcttttgtgacattgataactgggaacatgtcttttagagacctgggaagagtgatggttatggtgggcgctaccatgacggatgacataggtatgggagtgacttatcttgccctactagcagcttttaaagttagaccgacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagctgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaagtgggaagatcaggcagaaatatcaggaagcagcccaatcctgtcaataacaatatcagaagatggcagcatgtcgataaaaaatgaagaggaagaacaaacgctgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagccggagtctacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacatcttccgaaagaaaagattgaccatcatggacctccatccaggagcaggaaagacaaaaagataccttccagccatagttagagaagccataaaacgtggcctgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagctgggatttttatgacagccactcccccgggaagtagagacccatttcctcagagcaatgcaccaatcatggatgaggaaagagaaatccctgagcgttcgtggaattcaggacacgaatgggtcacggattttaaagggaagactgtttggtttgttccaagtataaaagcaggaaatgatatagcagcttgtcttaggaaaaatggaaagaaagtgatacaactcagtaggaagacctttgactctgagtatgttaagactagagccaatgattgggactttgtggtcacaactgacatttcagagatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaacgaaaatgaccagtacatatacatgggggaaccccttgaaaatgatgaagactgtgcacattggaaagaagctaaaatgctcctagataacatcaatacacccgaaggaatcattcctagtatgttcgaaccagagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatttattctgacccactggcactaaaagaattcaaggaatttgcagctggaagaaaatctttgaccctgaacctaatcacagaaatgggtaggcttccaactttcatgacccagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgccaaccaagctacagtgctaatgggtcttgggaaaggatggccattgtcaaagatggacattggagttcccctccttgccattggatgctattcacaagtcaaccccataactctcacagcagcccttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccattatgaaaaacacaacaagcacaagaagaggaactggcaacataggagagacacttggagaaaaatggaaaagtcgattaaacgcactaggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgatgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtattgggtatctaatgccaccgggaacatagtgtcatcagtgaacatgatttcaaggatgttgatcaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagttggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaatcttcaaaagcattcagcacctgacagccgcagaagaaaatgttgtacagaactggttggcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6655 - RNA, 9876 nt, synthetic construct
  misc_feature 1..9876: note = derived and/or modified CDS sequence (wt) from DENV-2__EU596483__SS-prME
  source 1..9876: mol_type = other RNA
acagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagaaccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacttttcttattgatggccctgaaacagcagaatgccccaacacaaacagagcttggaactcgctggaagttgaagactatggttttggagttttcaccaccaatatatggctgaaattgagagaaaagcaggatgtattttgtgactcaaaactcatgtcagcggccatcaaagacaacagagccgttcatgccgatatgggttattggatggaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaagcagaaatatcaggaagcagtccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggcgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagatatcttccagccatagttagagaagccataaaacgtggcttgagaacattgatcctggctcccactagagtagtggcagctgaaatggaagaagctcttagaggacttccaataagataccaaaccccagccatcaaaaccgagcacaccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaagggaaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggagccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacacagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccagttgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttctatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacccaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgctatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagagacaggtgtcctgtggtag

SEQ ID NO: 6656 - RNA, 9876 nt, synthetic construct
  misc_feature 1..9876: note = derived and/or modified CDS sequence (wt) from DENV-2__EU482597__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaagtgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttaggttctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtcttaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaattacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaactaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccagttttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaaattagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6657 - RNA, 9876 nt, synthetic construct
  misc_feature 1..9876: note = derived and/or modified CDS sequence (wt) from DENV-2__EU482598__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacggactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaaatcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggagaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcgagaaacgcactggacaacttggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacgacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgactaaacgcattggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcagagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagctacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagctgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6658 - RNA, 9876 nt, synthetic construct
  misc_feature 1..9876: note = derived and/or modified CDS sequence (wt) from DENV-2__EU482603__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacatagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacggaagccaaacaacctgccactctaaggaagtactgtatagaagcgaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttagaatacaccatcgtgataacaccccactcaggagaagagcacgctgtaggtaatgacacaggaaagcatggcaaagaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacagggcatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgatcacagttaacccaatcgtaacagaaaaagatagcccagtcaacatagaagcagaacctccattcggagacagctatatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgtagtgagttggaaaaataaagaactgaaatgtggcagcgggatcttcatcacagataacgtacacacatggacagaacaatataagtttcaaccagaatccccttcaaaactagcttcagctatccaaaaagctcatgcagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgaactgaagtactcatggaaaacatggggaaaggcgaaaatgctctccacagagtctcacaatcagacctttcttattgatggccctgagacagcagaatgccccaacacaaacagagcttggaattcgctggaagttgaagactatggttttggagttttcaccaccaatatatggctgaaattgagagaaaaacaggatgtattttgtgattcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtaactgaggactgtggaaatagaggaccctctttgagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgaataggaacgaaacatgcaatactgctagttgcagtatcttttgtgacattgataactgggaacatgtcttttagagacctgggaagagtgatggttatggtgggcgctaccatgacggatgacataggtatgggagtgacttatcttgccctactagcagcttttaaagttagaccgacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagagatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagccggagtctacaaagaaggaacattccatacaatgtggcacgtcacacgtggtgctgttctgatgcacagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtaagtgctatagcccagaccgaaaaaagcattgaagacaatccagagatcgaagatgacatcttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcccccgggaagtagagacccatttcctcagagcaatgcaccaatcatggatgaggaaagagaaatccctgagcgttcgtggaattcaggacacgaatgggtcacggattttaaagggaagactgtttggtttgttccaagtataaaagcaggaaatgatatagcagcttgtcttaggaaaaatggaaagaaagtgatacaactcagtaggaagacctttgactctgagtatgttaagactagagccaatgattgggactttgtggtcacaactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaacgaaaatgaccagtacatatacatgggggaacctcttgaaaatgatgaagactgtgcacattggaaagaagctaaaatgctcctagataacatcaatacacccgaaggaatcattcctagtatgttcgaaccagagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgacccagaaagcaagaaacgcactggacaacttggctgtgctgcatacggctgaggcaggtggaagggcgtacaatcatgctctcagtgaactgccggagaccctggagacactgcttttactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggaattttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgccaaccaggctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccattatgaaaaacacaacaagcacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgatgttttcttcaccccgccagaaaagtgtgatacattgttgtgtgacataggggagtcgtcaccaaatcccacgatagaagcaggacgaacactcagagtcctcaacttagtggaaaattggttgaacaataacacccagttttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgatcaacagattcacaatgaaacacaagaaaaccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggcaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaatcttcaaaagcattcagcacctgacagccacagaagaaattgttgtacagaactggttggcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaagaatacacagactacatgccatccatgaagagattcagaagggaagaggaagaggcaggtgtcctgtggtag

SEQ ID NO: 6659 - RNA, 9876 nt, synthetic construct
  misc_feature 1..9876: note = derived and/or modified CDS sequence (wt) from DENV-2__EU482599__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttattgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaaacatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcacgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggttatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaacatggaagtggaaatctggacaaaagaaggggaaaggaaaaaattaaaacccagatggttggatgctaggatctattctgacccactggcactaaaagaattcaaggagtttgcagctggaagaaaatctttgaccctgaacctaatcacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgccaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacatcttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6660 - RNA, 9876 nt, synthetic construct
  misc_feature 1..9876: note = derived and/or modified CDS sequence (wt) from DENV-2__FJ898436__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtttaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggacttcggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccctggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaagaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacacttctggctacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagcgtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaacctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6661 - RNA, 9876 nt, synthetic construct
  misc_feature 1..9876: note = derived and/or modified CDS sequence (wt) from DENV-2__EU482634__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacatagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcgaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggaatacaccatcgtgataacaccccactcaggagaagagcacgctgtaggtaatgacacaggaaagcatggcaaagaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgatcacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacttgggagctatggtgcaagctgatagtggttgcgtagtgagttggaaaaataaagaactgaaatgtggcagcgggatcttcattacagataacgtacacacatggacagaacaatataagtttcaaccagaatccccttcaaaactagcttcagctatccaaaaagctcatgaagagggcatttgtggaatccgctcagtaacaagattggagaatctgatgtggaaacaaataacaccagaattgaatcatattctagcagaaaatgaggtaaagttgaccattatgacaggagacattaaaggaatcatgcaggcaggaaaacgatctttgcggccccagcccactgaactgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttcaccaccaatatatggctgaaattgagagaaaaacaggatgtattttgtgattcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtaactgaggactgtggaaatagaggaccctctttgagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgaataggaacgaaacatgcaatactattagttgcagtatcttttgtgacattgataactgggaacatgtcttttagagacctgggaagagtgatggttatggtgggcgctaccatgacggatgacataggtatgggagtgacttatcttgccctactagcagcttttaaagttagaccgacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccaacaagaaaaggagctggccgctaaatgaagctatcatggcagtcgggatggtgagcattttagccagttctctcctaaagaatgatattcccatgacaggtccgttagtggctggagggctccttaccgtatgttacgtgctcactggacgatcggctgatttggaactggagagagctgctgatgtaaaatgggaagatcaggcagaaatatcgggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagccggagtctacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacatcttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcccccgggaagtagagacccatttcctcagagcaatgcaccaatcatggatgaggaaagagaaatccctgagcgttcgtggaattcaggacacgaatgggtcacggattttaaagggaagactgtttggtttgttccaagtataaaagcaggaaatgatatagcagcttgtcttaggaaaaatggaaagaaagtgatacaactcagtaggaagacctttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaacgaaaatgaccagtacatatacatgggggaacctcttgaaaatgatgaagactgtgcacattggaaagaagctaaaatgctcctagataacatcaatacacccgaaggaatcattcctagtatgttcgaaccagagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgacccagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgctgtggctacaacatttgtcacaccaatgttgagacatagcattgaaaattcctcagtgaatgtctccctaacagccattgccaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccaggaaggttttggaacactaccattgcagtgtcaatggccaacatctttagggggagctacttggccggagctggacttctcttttccattatgaaaaacacaacaagcacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacagaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgatgttttcttcaccccgccagaaaagtgtgatacattgttgtgtgacataggggagtcgtcaccaaatcccacgatagaagcaggacgaacactcagagtcctcaacttagtggaaaattggttgaacaataacaccaaattttgcataaaggtcctcaacccatatatgccttcagtcatagaaaaaatggaagcattacaaaggaaatatggaggagctttagtgaggaatccactctcacgaaactccacgcatgaaatgtactgggtatctaatgccaccgggaacatagtgtcatcagtgaacatgatttcaaggatgttgatcaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaatcttcaaaagcattcagcacctgacagccacagaagaaattgttgtacagaactggttagcaagagtggggcgtgaaaggctatcaagaatggcaatcagtggagatgattgtgttgtaaaacctatagatgacagatttgcaagtgctctaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6662 - RNA, 9876 nt, synthetic construct
  misc_feature 1..9876: note = derived and/or modified CDS sequence (wt) from DENV-2__EU482635__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaagtgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttaggttctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgataactgggaacatgtcttttagagacctgggaagagtgatggttatggtgggcgctaccatgacggatgacataggtatgggagtgacttatcttgccctactagcagcttttaaagttagaccgacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtattgtgggacgtcccttcacccccaccagtggaaaaagccgaactggaggatggagcctacagaatcaagcaaagagggatccttggatattctcagataggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaattacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaactaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccagttttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggttggcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6663 - RNA, 9876 nt, synthetic construct
  misc_feature 1..9876: note = derived and/or modified CDS sequence (wt) from DENV-2__GQ199874__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatggaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacatcagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccctgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6664 - RNA, 9876 nt, synthetic construct
  misc_feature 1..9876: note = derived and/or modified CDS sequence (wt) from DENV-2__EU482639__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatataccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttgctgttcacaggacatctcaagtgcaggctgagaatggacaaactacagctcaaaggaatgtcatactccatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggctaccataggaatcgcactcctttcccaaagcaccataccagagaccattctagaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccaccagagtagtggcagctgaaatggaggaagctcttagaggacttccaataagataccaaactacagctatcaaaaccgaacataccgggcgggagatcgtggacctaatgtgtcatgccacatttactatgaggctgttatcaccagtcagagtgccaaattacaacctgatcatcatggacgaagcccactttacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaagggaagactgtttggtttgttccaagcataaaagcaggaaatgatatagcagcttgtcttaggaaaaatggaaagaaagtgatacaactcagtaggaagacttttgactctgagtatgttaagactagagccaatgattgggactttgtggtcacgactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataatatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatttattctgacccactggcactaaaagaattcaaggaatttgcagctggaagaaaatctttgaccctgaacctaattacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacacttgtcacaccaatgttgagacacagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagaggaggctggtcatactattgcgggggactaaagaatgtaagagaagtcaaaggcctaacaaaaggaggaccaggacatgaagaacccatccccatgtcaacatatgggtggaatttagtgcgtctgcaaagtggagttgacgttttcttcaccccgccagaaaagtgtgaaacattgttgtgtgacataggggagtcgtcaccaaatcccacgatagaagcaggacgaacactcagagtcctcaacttagtggaaaattggttgaacaataacacccaattctgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacataggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaaattagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacttggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6665 - RNA, 9876 nt, synthetic construct
  misc_feature 1..9876: note = derived and/or modified CDS sequence (wt) from DENV-2__EU482766__SS-prME
  source 1..9876: mol_type = other RNA
acagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctcttcgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggatatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaagaatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6666 - RNA, 9876 nt, synthetic construct
  misc_feature 1..9876: note = derived and/or modified CDS sequence (wt) from DENV-2__EU482695__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttattgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaaacatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcacgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgaccatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgttccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggagtttgcagctggaagaaaatctttgaccctgaacctaatcacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgccaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgagacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacatcttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtatcaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 6667 - RNA, 9876 nt, synthetic construct
  misc_feature 1..9876: note = derived and/or modified CDS sequence (wt) from DENV-2__EU482769__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgttacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaattccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagtagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatacggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacctggctgtgctgcatacggctgaggcaggtggaagggcgtacaatcatgctctcagtgaactgccggagaccttggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatacatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacccatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcaatgattgggctaacaagcagggctacctgggcaaagaacatccaaacagcaataaatcaagtcagatcccttataggcaatgaggaatacatagactacatgccatccatgaagagatttagaagggaagaggaagaggcaggtgtcctgtggtag

SEQ ID NO: 6668 - RNA, 9876 nt, synthetic construct
  misc_feature 1..9876: note = derived and/or modified CDS sequence (wt) from DENV-2__EU482696__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaggatacaatcacgtacaagtgtcctctcctcagacaaaatgaaccagaagacatagattgttggtgcaactctacgtccacatgggtaacttatgggacatgcaccaccacaggagaacatagaagagaaaaaagatcagtggcgctcgttccacatgtgggtatgggactggagacacgaactgagacatggatgtcatcagaaggggcctggaaacatgttcagagaatcgaaacctggatcttgagacatccaggctttaccataatggcagcaatcctggcatacaccataggaacgacacatttccaaagggccttgattttcatcttactaacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcgaagctgaccaacacaacaacagaatcacgctgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggaatacaccatcgtgataacaccccactcaggagaagagcacgctgtaggtaatgacacaggaaagcatggcaaagaaatcaaaataacaccgcagagttccatcacagaagcagaactgacaggctatggcactgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcatacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgatcacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgtagcgagttggaaaaataaagaactgaaatgcggcagcgggatcttcatcacagataacgtacacacatggacagaacaatataagtttcaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttcaccaccaatatatggctgaaattgagagaaaaacaggatgtattttgtgattcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtaactgaggactgtggaaatagaggaccctctttgagaacgaccactgcctctggaaaactcataacagaatggtgctgccgatcctgcacactaccacctctaagatacagaggtgaggatggatgctggtatgggatggaaattagaccattgaaagagaaagaggagaatttggtcaattccttggtcacagccggacatgggcagattgacaacttttcactaggagtcttgggaatggcactgttcctggaagaaatgctcaggacccgaataggaacgaaacatgcaacactactagttgcagtatcttttgtgacattgataactgggaacatgtcttttagagacctgggaagagtgatggttatggtgggcgctaccatgacggatgacataggtatgggagtgacttatcttgccctactagcagcttttaaagttagaccgacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagctgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggccggagggctccttaccgtatgttacgtgctcactggacgatcggccgatttggaactggagagagctgccgatgtaaagtgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagccggagtctacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaactttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacatcttccgaaagaaaagattgaccatcatggacctccatccaggagcaggaaagacaaaaagataccttccagccatagttagagaagccataaaacgtggcctgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaagggaagactgtttggtttgttccaagtataaaagcaggaaatgatatagcagcttgtcttaggaaaaatggaaagaaagtgatacaactcagtaggaagacctttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaacgaaaatgaccagtacatatacatgggggaacctcttgaaaatgatgaagactgtgcacattggaaagaagctaaaatgctcctagataacatcaatacacccgaaggaatcattcctagtatgttcgaaccagagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgacccagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgccaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcattatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccattatgaaaaacacaacaagcacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgatgtttttttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtattgggtatctaatgccaccgggaacatagtgtcatcagtgaacatgatttcaaggatgttgatcaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagttggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcatagtaatggatatcatatcgagaagagaccaaagaggcagtgggcaagtcggcacctatggccttaacactttcaccaatatggaagcccaattaattagacagatggagggagaaggaatcttcaaaagcattcagcacctgacagccgcagaagaaattgttgtacagaactggttggcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6669 - RNA, 9876 nt, synthetic construct
  misc_feature 1..9876: note = derived and/or modified CDS sequence (wt) from DENV-2__KC294207__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtaggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgatatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcactgtcacgatggagtgctccccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaattacagctcaaaggaatgtcatactgtatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctcaacagagtctcacaaccagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatgataattccaaaaaattttgccgggccagtgtcacaacacaactacagaccgggctaccatacacaaacagcaggacctgggcatctaggtaagcttgagatggactttgatttgtgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgactttgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagccatttttctaacaactctttcgagaaccagcaaaaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagagaattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagactgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacactaatcctggctcccactagagtcgtggcagctgaaatggaagaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaattattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgatccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtgtagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgccaaccaagctacagtgctaatgggtcttgggaaaggatggccattgtcaaagatggacatcggagttcccctccttgccattggatgctactcacaagtcaaccccataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaatgtgggagagacgcttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatattattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgacacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacatagtgggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaatcacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacataagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggtagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 6670 - RNA, 9876 nt, synthetic construct
  misc_feature 1..9876: note = derived and/or modified CDS sequence (wt) from DENV-2__KC294208__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtaggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgatatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggtattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcactgtcacgatggagtgctccccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaattacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctcaacagagtctcacaaccagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatgataattccaaaaaattttgccgggccagtgtcacaacacaactacagaccgggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagagaattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagactgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacactaatcctggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaattattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgatccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgccaaccaagctacagtgctaatgggtcttgggaaaggatggccactgtcaaagatggacatcggagttcccctccttgccattggatgctactcacaagtcaaccccataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggagatccagggaggttttggaacaccaccattgcagtgtcaatggctaacatctttagggggagctacttggccggagctggacttctcttttccatcatgaagaacacaacaaacacaagaagaggaactggcaatgtgggagagacgcttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatattattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgacacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacatagtgggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaatcacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacataagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggtagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 6671 - RNA, 9876 nt, synthetic construct
  misc_feature 1..9876: note = derived and/or modified CDS sequence (wt) from DENV-2__KC294209__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtaggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgatatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcactgtcacgatggagtgctccccgagaacaggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaattacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctcaacagagtctcacaaccagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagagaattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagactgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacactaatcctggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaattattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgatccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtgtagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgccaaccaagctacagtgctaatgggtcttgggaaaggatggccattgtcaaagatggacatcggagttcccctccttgccattggatgctactcacaagtcaaccccataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaatgtgggagagacgcttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatattattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgacacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacatagtgggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaatcacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacataagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggtagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 6672 - RNA, 9876 nt, synthetic construct
  misc_feature 1..9876: note = derived and/or modified CDS sequence (wt) from DENV-2__KC294214__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccactggagaacacagaagagaaaaaagatcagtggcgctcgttccacatgtaggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgatatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcactgtcacgatggagtgctccccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaattacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggagaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctcaacagagtctcacaaccagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagagaattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagactgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacactaatcctggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaattattcctagtatgttcgagccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgatccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcttggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgccaaccaagctacagtgctaatgggtcttgggaaaggatggccattgtcaaagatggacatcggagttcccctccttgccattggatgctactcacaagtcaaccccataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgcttctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaatgtgggagagacgcttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatattattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgacacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacatagtgggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaatcacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccatatgaaaggagaacataagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccaccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggtagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 6673 - RNA, 9876 nt, synthetic construct
  misc_feature 1..9876: note = derived and/or modified CDS sequence (wt) from DENV-2__KC294205__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtaggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgatatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcactgtcacgatggagtgctccccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaattacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctcaacagagtctcacaaccagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacaccagaaagcggattggataccactggcactgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagagaattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagactgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacactaatcctggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaattattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgatccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgccaaccaagctacagtgctaatgggtcttgggaaaggatggccattgtcaaagatggacatcggagttcccctccttgccattggatgctactcacaagtcaaccccataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccggacccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaatgtgggagagacgcttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggttacaccggaagggaaggtggtggatcttggttgtggcagagggggctggtcatattattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgacacgttgttgtgtgacataggggagtcgtcaccaaatcccacgatagaagcaggacgaacactcagagtcctcaacttagtggaaaattggctgaacactaacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacatagtgggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaatcacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacataagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggtagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 6674 - RNA, 9876 nt, synthetic construct
  misc_feature 1..9876: note = derived and/or modified CDS sequence (wt) from DENV-2__KC294210__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtaggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgatatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggtattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcactgtcatgatggagtcctccccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaattacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctcaacagagtctcacaaccagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatgataattccaaaaaattttgccgggccagtgtcacaacacaactacagaccgggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaagaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagagaattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagactgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacactaatcctggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaattattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgatccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgccaaccaagctacagtgctaatgggtcttgggaaaggatggccattgtcaaagatggacatcggagttcccctccttgccattggatgctactcacaagtcaaccccataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaatgtgggagagacgcttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatattattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgacacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacatagtgggaaagagaatagagaaaataaaacaagagcatgaaacatcatggcattatgaccaagatcacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaatcacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacataagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagtaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggtagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 6675 - RNA, 9876 nt, synthetic construct
  misc_feature 1..9876: note = derived and/or modified CDS sequence (wt) from DENV-2__KC294215__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgcaccaccacaggagaacacagaagagaaaaaagatcagtggcgctcgttccacatgtaggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgatatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggtattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcactgtcacgatggagtgctccccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaattacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccaggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctcaacagagtctcacaaccagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatgataattccaaaaaattttgccgggccagtgtcacaacacaactacagaccgggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagccatttttctaacaactctttcgagaaccagcaagaaaagaagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagagaattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagactgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacactaatcctggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggatgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcacaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaattattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgatccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgccaaccaagctacagtgctaatgggtcttgggaaaggatggccattgtcaaagatggacatcggagttcccctccttgccattggatgctactcacaagtcaaccccataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaatgtgggagagacgcttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatattattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgacacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacatagtgggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaatcacggcaaagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacataagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggtagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 6676 - RNA, 9876 nt, synthetic construct
  misc_feature 1..9876: note = derived and/or modified CDS sequence (wt) from DENV-2__KC294216__SS-prME
  source 1..9876: mol_type = other RNA
acagcaggagtgattattatgttgattccaacagcaatggcgttccatctaaccacacgtaatggagaaccacacatgatcgttggtaggcaagagaaagggaaaagtcttctgtttaaaacagaggatggtgtcaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcctgagacatccaggctttgccataatggcagcaatcctggcatacaccataggaacaacacatttccaaagagccttgatttttatcttactgacagctgtcgctccttcgatgacaatgcgttgcataggaatatcaaacagagacttcgtagaaggggtttcaggaggaagctgggttgacatagtcttagaacatggaagttgtgtgacgacgatggcaaaaaacaaaccaacattggatcttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcgaggaaatcaaaataacaccacagagttccatcacagaagcagaactgacaggctatggcactgtcacgatggagtgctctccgagaacgggcctcgacttcaatgagatggtgctgctgcagatggaagagaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccatattaggtgacacagcctgggattttggatccctgggaggagtgtttacatctattggaaaggctctccaccaagttttcggagcaatctatggggctgcttttagtggggtctcatggactatgaaaatcctcataggagtcatcatcacatggataggaatgaattcacgtagtacctcactgtctgtgtcactagtattggtgggagtcgtgacactgtacctgggagctatggtgcaggctgatagtggttgcgttgtgagctggaagaacaaagaattgaaatgtggcagcgggatattcattacagataacgtgcacacatggacagagcaatataagttccaaccagaatccccttcaaaactagcttcagctatccaaaaagctcatgaagagggcatttgtggaatccgctcagtgacaagattggagaatctgatgtggaaacaaataacaccagaattgaatcacatcctatcagaaaatgaggtaaagttgaccattatgacaggagacatcaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacgaacagagcttggaactcgttggaagttgaagactatggttttggagtttttaccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaagtcaaaagctgccactggccaaagtcccacaccctctggagcaatggagtattggaaagtgagatgataattccaaaaaattttgccgggccagtgtcacaacacaactacagaccaggctaccacacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatacagaggtgaggatggatgctggtacgggatggaaatcagaccgttgaaagagaaagaggagaatttggtcaactccttggtcacagccggacatgggcagattgacaacttttcgctaggagtcttgggaatggcactgtttctggaagaaatgctcaggacccgagtaggaacgaaacatgcaatactgttagtcgcagtatcttttttgacattgatcactgggaacatgtcctttagagacttgggaagagtgatggttatggtgggcgttgccatgacggatgatataggtatgggagtgacttaccttgccctattagcagctttcaaagttagaccaactttcgcagctggactactcttgagaaaactgacctccaaggaattaatgatggccaccataggaattacactcctttcccaaagcaccacaccagaaaccattcttgaactgactgatgcgttagccttgggcatgatggtcctaaaaatagtgagaaatatggaaaagtaccaattggcagtgaccatcatgactatctcgtgtgtcccaaatgcaatgatactgataaacgcatggaaggtgagttgcacaatattggcagtggtgtccgtttctccattgctcctaacatcctcacagcagaaaacggattggataccattggcattgacgataaaaggtctcaatccaacagccatctttctaacaaccctttcgagaaccagcaagaaaaggagctggccgctaaacgaagctgtcatggcagtcgggatggtgagcattttagccagttctctcctaaagaatgacattcctatgacaggtccattagtggctggagggctccttactgtgtgttacgtgctcactggacgatcggccgatttggaactggagagagctgccgatgtgaaatgggaagatcaggcagaaatatcaggaagcagcccaatcctgtcaataacaatatcagaagatggcagcatgtcgataaagaatgaagaggaagaacaaacactgaccatactcatcagaacgggattgctggtgatctcaggagtttttccagtatcgataccaatcacggcagcagcatggtacctgtgggaagtgagaaaacaacgggctggagtattgtgggacgtcccttcacctccaccagtggaaaaagccgaactggaagatggagcttatagaatcaagcaaagagggattcttggatattctcagattggagctggagtttacaaagaaggaacattccacacaatgtggcacgtcacacgtggtgctgttctgatgcatagagggaaaaggatcgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaagaccaacaccggaaccataggcgccgtgtctctggacttttcccctggaacgtcaggatctccaattgtcgatagaaaaggaaaagttgtgggcctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcggctgaaatggaggaagctcttagaggacttccaataagataccaaaccccagctatcagagccgagcacaccgggcgggagattgtggatctaatgtgtcatgccacatttactatgaggctactatcaccagtcagagtgccaaattacaacctgattatcatggatgaagcccatttcacagatccagcaagtatagcagctagaggatatatttcaactcgagtagaaatgggtgaagcagctgggattttcatgacagctactcctccgggaagtagagacccatttccccagagcaatgcaccaatcatggatgaggaaagagaaatccctgagcgctcgtggaattcaggacatgaatgggtcacagattttaaagggaagactgtttggttcgttccaagtataaaagcaggaaatgacatagcagcttgtctcagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagtcatactaacagatggcgaagagcgagtgattttggcaggacctatgccagtgacccactctagtgcagcacaaagaagagggagagtaggaagaaatccaaaaaatgaaaatgaccagtacatttacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgagggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggataacttagctgtgctgcatacggctgaggcaggtggaagggcgtacaatcatgctctcagtgaactgccggagaccctggagacactgcttttactgacactcctggccacagtcacaggaggaatcttcttatttttaatgagcggaaaaggtatagggaagatgactctgggaatgtgttgcataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggattcctggaaaaaaccaagagagacctcggactgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatgggataacagtaattgatctagaaccaataccctatgatccaaaatttgaaaaacagttaggacaagtaatgctcctaatcctctgcgtgactcaagtattaatgatgaggactacatgggctctgtgtgaggctctaaccctagcgaccgggcccatctccacactgtgggaaggaaatccagggaggttctggaacactaccattgcagtgtcaatggctaacatctttagggggagctacttggccggagctggacttctcttttccattatgaagaacacaacaaacacaagaagaggaactggcaacataggagagacacttggagaaaaatggaaaagccgattaaacgcactgggaaaaagtgaatttcagatctacaagagaagtggaatccaggaagtggacagaaccttggcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagaggtggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgtcttcttcaccccgccagaaaagtgtgatacattgttgtgtgacataggggagtcgtcaccaaatcccacgatagaagcaggacggacactcagagtcctcaacttagtggaaaattggttgaacaacaacacccaattttgcataaaggttctcaacccatatatgccctcagtcatagaaaaaatggaaacactacaaaggaaatacggaggagctttagtgaggaatccactctcacgaaactccacacacgaaatgtactgggtatccaatgctaccgggaacatagtgtcatcagtgaacatgatttcgaggatgttgatcaatagattcacaatgaaacacaagaaagccacctacgagccagatgttgacctaggaagcggaacccgcaacattggaattgaaagtgagataccaaatttagccataataggaaagagaatagagaaaataaagcaagagcatgaaacatcatggcactatgaccaagaccacccatacaaaacatgggcttaccatggtagctatgaaacaaaacaaactggatcagcatcatctatggtgaacggagtggtcagactgctgacaaaaccttgggacgtcgtcccaatggtgacacagatggcaatgacagacacgactccatttggacaacaacgcgtcttcaaagagaaagtggacacgagaacccaagaaccgaaggaaggcacaaagaaactgatgagaattacggcagagtggctttggaaagaactaggaaagaaaaagacacctaggatgtgtaccagagaagaattcacaagaaaggtgagaagcaatgcagccttgggggccatattcactgatgaaaacaaatggaaatcggctcgtgaggctgttgaagacagtaggttttgggagctggttgacagggaaagaaatctccatcttgaaggaaagtgtgaaacatgtgtgtacaacatgatgggaaaaagagagaagaagctaggggagttcggcaaggcaaaaggtagcagagccatatggtacatgtggcttggagcacgctttttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagagcacaagaaactagccgaggccgtattcaaattaacgtaccaaaacaaggtggtgcgtgtgcaaagaccaacaccaagaggcacagtaatggatatcatatcgagaagagaccaaagaggcagcgggcaagtcggcacctatggcctcaatactttcaccaacatggaagcccaactaattagacagatggagggagaaggaatcttcaaaagcattcagcacctgacagccacagaagaaatcgctgtacagaactggttagcaagagtggggcgtgaaaggctatcaagaatggccatcagtggagatgattgtgttgtaaaacccttagatgacagatttgcaagtgctttaacagctctaaatgacatgggaaaagttaggaaagatatacaacaatgggaaccttcaagaggatggaacgactggacacaagtgcctttctgttcacaccactttcatgagttagtcatgaaagatggtcgcgtgcttgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacactgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatatttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaagcaggtgtcctgtggtag

SEQ ID NO: 6677 - RNA, 9876 nt, synthetic construct
  misc_feature 1..9876: note = derived and/or modified CDS sequence (wt) from DENV-2__KC294218__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtaggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttgatcttactgacagctgttgctccttcaatgacaatgcgctgcataggaatatcaaatagagacttcgtagaaggggtttcaggaggaagctgggttgatatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggtattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcactgtcacgatggagtgctccccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaattacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctcaacagagtctcacaaccagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatgataattccaaaaaattttgccgggccagtgtcacaacacaactacagaccgggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagatctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagagaattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagactgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacactaatcctggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaattattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgatccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgccaaccaagctacagtgctaatgggtcttgggaaaggatggccattgtcaaagatggacatcggagttcccctccttgccattggatgctactcacaagtcaaccccataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaatgtgggagagacgcttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatattattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgacacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacatagtgggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaatcacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacataagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggtagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 6678 - RNA, 9876 nt, synthetic construct
  misc_feature 1..9876: note = derived and/or modified CDS sequence (wt) from DENV-2__KC294220__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtaggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgatatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcactgtcacgatggagtgctccccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaattacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctcaacagagtctcacaaccagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagagaattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagactgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacactaatcctggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaattattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgatccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgccaaccaagctacagtgctaatgggtcttgggaaaggatggccattgtcaaagatggacatcggagttcccctccttgccattggatgctactcacaagtcaaccccataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaatgtgggagagacgcttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatattattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaatgtgtgacacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacatagtgggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaatcacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacataagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggtagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 6679 - RNA, 9876 nt, synthetic construct
  misc_feature 1..9876: note = derived and/or modified CDS sequence (wt) from DENV-2__KC294221__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtaggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgatatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcgtggaaaggaaatcaaaataacaccacagagttccaccacagaagcagaactgacaggctatggcactgtcacgatggagtgctccccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaattacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctcaacagagtctcacaaccagacctttcttattgatggccctgaaacagcagaatgccccaacacaaacagagcttggaactcactggaagttgaagactatggttttggagttttttccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagagaattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagactgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacactaatcctggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaattattcctagtatgttcgagccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatttggacaaaagaaggggaaaggaaaaaattaaaacccagatggttggatgctaggatctattctgatccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgccaaccaagctacagtgctaatgggtcttgggaaaggatggccattgtcaaagatggacatcggagttcccctccttgccattggatgctactcacaagtcaaccccataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaatgtgggagagacgcttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatattattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgacacattgttgtgtgacataggggagtcgtcaccaaatcccacgatagaagcaggacgaacactcagagtcctcaatttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacatagtgggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaatcacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacataagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggtagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 6680 - RNA, 9876 nt, synthetic construct
  misc_feature 1..9876: note = derived and/or modified CDS sequence (wt) from DENV-2__KC294223__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtaggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgatatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcactgtcacgatggagtgctccccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaattacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctcaacagagtctcacaaccagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagagaattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagactgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacactaatcctggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaattattcctagtatgttcgagccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgatccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgccaaccaagctacagtgctaatgggtcttgggaaaggatggccattgtcaaagatggacatcggagttcccctccttgccattggatgctactcacaagtcaaccccataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaatgtgggagagacgcttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatattattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgacacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacatagtgggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaatcacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacataagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggtagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 6681 - RNA, 9876 nt, synthetic construct
  misc_feature 1..9876: note = derived and/or modified CDS sequence (wt) from DENV-2__FJ906959__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctgtttaaaacagaggatggtgtgaacatgtgtaccctcatggccatggaccttggtgaattgtgtgaagatacaatcacgtacaagtgtccttttctcaagcagaatgaaccagaagacatagattgttggtgcaactctacgtccacatgggtaacttatgggacgtgtaccaccacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccataatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacagaagccaaacaacctgccactctaaggaagtactgtatagaggcaaagctgaccaacacaacaacagattctcgctgcccaacacaaggagaacccagcctaaatgaagagcaggacaaaaggttcgtctgcaaacactccatggtggacagaggatggggaaatggatgtggactatttggaaaaggaggcattgtgacctgtgctatgttcacatgcaaaaagaacatgaaaggaaaagtcgtgcaaccagaaaacttggaatacaccattgtgataacacctcactcaggggaagagcatgcagtcggaaatgacacaggaaaacatggcaaggaaatcaaaataacaccacagagttccatcacagaagcagagttgacaggctatggcactgtcacgatggagtgctctccgagaacgggcctcgacttcaatgagatggtgttgctgcaaatggaaaataaagcttggctggtgcacaggcaatggttcctagacctgccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggaaacttactgttcacaggacatctcaagtgcaggctgaggatggacaaactacagctcaaaggaatgtcatactctatgtgcacaggaaagtttaaagttgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacagaaaaagatagcccagtcaacatagaagcagaacctccattcggagacagctacatcatcataggagtagagccgggacaattgaagctcaactggtttaagaaaggaagttctatcggccaaatgattgagacaacaatgaggggagcgaagagaatggccattttaggtgacacagcttgggattttggatccctgggaggagtgtttacatctataggaaaggctctccaccaagttttcggagcaatctatggggctgccttcagtggggtctcatggattatgaaaatcctcataggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaagtgtggcagtgggattttcatcacagacaacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcagccccagcccactgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaaaagcaggatgtattctgcgactcaaaactcatgtcagcggccataaaagacaacagagccgtccatgccgatatgggttattggatagaaagtgcactcaatgacacatggaagatagagaaagcctctttcatcgaagttaaaagctgccactggccaaagtcacacaccctctggagtaatggagtgttagaaagtgagatgataattccaaagaatttcgctggaccagtgtcacaacacaactacagaccaggctaccatacacaaacagcaggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccataggaatcgtactcctctcccagagcaccataccagagaccattcttgaactgactgatgcgttagccttgggcatgatggtccttaaaatggtgagaaaaatggaaaagtatcaattggcagtgactatcatggctatcttgtgcgtcccaaatgcagtgatattacaaaacgcatggaaagtgagttgcacaatattggcagtggtgtccgtttccccactgttcttaacatcctcacagcagaaagcggattggataccattagcattgacgatcaagggtctcaatccaacagctatttttctaacaaccctttcaagaaccaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctgtatcaataccaatcacggcagcagcatggtacctgtgggaagtgaagaaacaacgggctggagtattgtgggatgtcccttcacccccacccgtgggaaaggctgaactggaagatggagcctatagaatcaagcaaaaagggattcttggatattcccagatcggagccggagtttacaaagaaggaacattccatacaatgtggcatgtcacacgcggcgctgttctaatgcataaaggaaagaggattgaaccatcatgggcggacgttaagaaagacctaatatcatatggaggaggctggaagctagaaggagaatggaaggaaggagaagaagtccaggtcttggcattggagcctggaaaaaatccaagagccgtccaaacaaaacctggtcttttcaaaaccaacgccggaaccataggtgccgtatctctggacttttctcctggaacctcaggatctccaatcatcgacaaaaaaggaaaagttgtgggtctttatggtaatggtgttgttacaaggagtggagcatatgtgagtgctatagcccagactgaaaaaagtattgaagacaatccagagatcgaagatgacatttttcgaaagagaaaattgaccatcatggacctccacccaggagcgggaaagacgaagagataccttccggccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataaaagcaggaaatgatatagcagcttgcctgagaaaaaatggaaagaaagtgatacaactcagtaggaagacctttgattctgagtatgtcaagactagaaccaatgattgggacttcgtggtcacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagctgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaggatctactctgacccactggcgctaaaggaattcaaggagtttgcagctggaagaaagtccctgaccctgaacctaatcacagaaatgggtaggcttccaactttcatgactcagaaggcaagagacgcactggacaacttagcagtgctgcacacggctgaagcaggtggaagggcgtacaatcatgctctcagtgaactgccggagaccctggagacattgcttttactgacacttctggctacagtcacaggaggaatctttttattcttgatgagcggaaggggtatagggaagatgaccctgggaatgtgctgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcattacaacccagcaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaagcaaccagagaagctcagaaaagagcagcagcgggcatcatgaaaaacccaactgtcgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacatttttagagggagttacttggccggagctggacttctcttttccatcatgaagaacacaaccaacacgagaaggggaactggcaacataggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctaacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgagacacaagaaagccacttacgagccagatgtagacctcggaagcggaacccgcaacatcggaattgaaagtgagataccaaacctagacataatcgggaaaagaatagaaaaaataaaacaagagcatgaaacatcatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtgacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtataacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccttgagtggagtggaaggagaagggctgcacaagctaggttacattttaagagacgtgagcaagaaagagggaggagcaatgtatgccgatgacaccgcaggatgggacacaagaatcacactagaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagtcttcaaaagcattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtacttgtagttccatgcagaaaccaagatgaactgattggtagagcccgaatttcccaaggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6682 - RNA, 9876 nt, synthetic construct
  misc_feature 1..9876: note = derived and/or modified CDS sequence (wt) from DENV-2__KF360005__SS-prME
  source 1..9876: mol_type = other RNA
accgcaggcgtgatcatcatgcggattccaacagcaatggcgttccatttaaccacacgcaacggagaaccacacatgatcgtcagcaaacaagagaaagggaaaagtctcttgtttaaaacagaggatggtgtgaacatgtgcaccctcatggccatggaccttggtgaactgtgtgaagacacaatcacttataactgtcctcttctcaggcagaatgaaccagaagatatagattgttggtgtaactccacgtccacatgggtaacttatgggacatgcactgccacaggagaacacagaagggaaaaaagatcagtggcactcgtcccacatgtgggaatgggattggagacacgaactgaaacgtggatgtcatcagaaggggcctggaaacacgcccagagaattgaaacctggatcttgagacatccaggttttaccataatggcagcaatcttggcatacaccataggaacgacatatttccaaagagtcctgatcttcatcttactgacagctgtcgctccttcaatgacaatgcgttgtattggaatatcaaatagagactttgtggaaggggtttcaggaggaagctgggttgacatagtcttagaacatggaagctgtgtgacaacgatggcaaaaaacaaaccaacattggactttgaactgataaaaacagaagccaagcaacctgccactctaaggaagtactgtatagaggcaaagctgaccaacacaacaacagcatctcgatgcccaacacaaggggaacccagcctaaatgaagaacaggacaaaaggtttgtctgcaaacattccatggtaggcagaggatggggagatggatgtggattatttggaaagggaggcattgtgacctgtgctatgttcacatgcaagaaaaacatggaagggaaaattgtgcaaccagaaaacctggaatacaccattgtggtaacacctcattcaggggaagagaatgcagttggaaacgacacaggaaaacatggcaaggaaatcaaagtgacaccacagagttccattacagaagcagaactgacaggctacggcactgtcacgatggagtgctctccaagaacgggcctcgacttcaatgagatggtgttgctgcaaatggaaaacaaggcttggctggtgcacaggcaatggttcctagacctgccgttaccatggttgcccggagcggacatacaaggatcaaattggatacagaaggagacgttggtcactttcaaaaatccccatgcgaagaaacaggatgttgttgttttaggatcccaagaaggggctttgcataccgcacttacaggggccacggaaatccagatgtcatcaggaaacctactgttcacaggacatctcaagtgcaggctgagaatggataaattacagctcaaaggaatgtcatactctatgtgtacaggaaagtttaaagttgtaaaggaaatagcagaaacacaacatggaacaatagttgtcagaatacaatatgaaggggatggctctccatgtaaaatcccttttgagataatggatttggaaaaaagacatgtcttaggtcgcctgattacagtcaacccaatcgtcacagaaaaagacagtccagtcaacatagaagcagaacccccattcggagacagctacatcattataggagtagaaccgggacaactgaagctcagctggtttaagaaaggaagctcaatcggccaaatgttcgagactacaatgagaggagcgaagagaatggccattttaggtgacacagcctgggattttggatccctgggaggagtgttcacatctataggaaaggccctccaccaagtctttggagcaatctatggggctgccttcagtggggtttcatggactatgaaaatcctcataggagttgtcatcacatggataggaatgaattcacgtagcacctcactgtctgtgtcactagtattagtgggagtcgtgacattgtacttgggagttatggtgcaggctgatagtggttgtgttgtgagttggagaaacaaagaactgaaatgtggcagtgggattttcatcacagacaatgtacatacatggacagaacaatacaaattccaaccagaatccccctcaaagctggcttcagctatccagaaagctcatgaagaaggcatttgtggaatccgctcagtaacaagactggagaatctaatgtggaagcaaataacaccagaactgaatcacattctatcagaaaatgaggtaaagttgtctatcatgacaggggacatcaaaggaatcatgcaggcaggaaaacgatccctgcggcctcagcccactgagctgaaatattcatggaaaacgtggggcaaagcgaaaatgctctccacagagcctcataaccagacctttctcatcgatggccccgaaacagcagaatgtcccaacacaaacagagcttggaactcactagaagttgaagactacggctttggggtattcaccaccaacatatggctgaagttgaaagaaaggcaggatgtgttttgtgactcaaaactcatgtcagcggccataaaagacaacagagccgtccatgccgatatgggttattggatagaaagcgcacttaatgacacatggaagatagaaaaagcttcttttatcgaagttaaaagttgccactggccaaaatcacatactctctggagtaacggagtgctagaaagtgagatgataattccaaagaattttgctggaccagtatcgcaacataattacagaccaggctatcacacacaaacggcaggaccttggcatctaggcaagcttgagatggactttgatttttgcgaaggaaccacagtggtggtgactgaggactgcggaaatagaggaccctctctaagaacaactactgcttctggaaaactcataacagaatggtgctgccgatcctgcacattaccaccactaagatacagaggcgaggatggatgctggtacggaatggaaatcagaccattgaaagagaaagaagagaacttggtcaattctttggtcacagccggacatggacagattgacaacttctcactaggagtcttgggaatggcactgttcctggaagaaatgctcaggacccgagtgggaacaaaacatgcagtattactggttgcagtttctttcatgacattgatcacagggaacatgtctttccgagacctggggagagtgatggtcatggtgggggccgctatgacggatgacataggtatgggcgtgacttatcttgccttactagcagccttcaaagttagaccaacttttgcagctggactgcttttgagaaagctgacctccaaggaattgatgatgaccaccataggaatcgtactcctctcccagagcaccacaccagagactatacttgaactgactgatgcgttggccttgggcatgatgattctcaagatagtgagaaacatggaaaagtatcaattggcagtgactatcatggctatcttatgtgttccaaatgcagtgatattacaaaatgcatggaaagtgagctgcacaatactggcagcggtgtccgtatccccactgctcttaacatcttcgcagcagaaagcggattggataccattggcattgacgatcaaaggtctcaatccaacagccattttcctaacaaccctttcaagaactaacaagaaaaggagttggccactaaatgaggctatcatggcagtcgggatggtgagcattctagctagttctctcttgaagaatgacattcccatgacaggaccattagtggctggagggcttctcactgtgtgttacgtgctcactggaagatcggccgacctggaactagagagagccgccgacgttagatgggaagatcaggcagaagtatcaggaagcagtccaattctgtcaataacaatatcggaagatggcagcatgtcgataaaaaatgaagaggaagaacaaacactgaccatactcattagaacaggattgctggtgatatcaggacttttccccgtatcaataccaattacggcagcagcatggtacctgtgggaagtgaagaaacaacgggctggagtattgtcggctgttccttcacccccacctgtgggaaaggccgaactggaagatggagcttacagaatcaagcagaaagggattcttggatactcccagatcggagctggagtttacaaagaaggaacattccacacaatgtggcacgtcacacgtggtgctgttctaatgcacaaagggaagaggattgaaccatcatgggcggatgtcaggaaagacctaatatcgtatggaggaggccggaagctagaaggagaatggaaggaaggagaagaagtccaggtcttggcattagagcctggaaagaatccaagagccgtccaaacaaaacccggtctttttaagactaacaccggaaccataggcgctgtgtccctagacttttctcctggagcgtcaggatctccaatcgtcgacaaaaaaggaaaagtcgtgggtctctatggtaatggtgtcgtcacaaggagtggaacatatgtgagtgccatagcccagactgaaaaaagcattgaagacaatccagagattgaagacgatatctttcgaaaaaaaagattgaccattatggacctccacccaggagcgggaaagacgaaaagataccttccagcaatagttagagaggccataaaacgaggcttaagaacattaatcctggcccccactagagtcgtggcagctgaaatggaagaagctcttagaggacttccaataagataccaaaccccagccatcagagctgagcacactgggcgagaaatcgtggatttaatgtgtcatgccacatttaccatgaggctgttatcaccagttagagtgccaaattacaacttgatcattatggatgaagcccatttcacagacccagcaagcatagcagctagaggatacatttcaactcgagtagagatgggtgaagcagctgggattttcatgacagccactcctccgggaagcagagacccatttcctcaaagcaatgcaccaatcatggatgaagaaagggaaatccctgaacgttcgtggaactctggacatgagtgggttacagatttcaaagggaagactgtttggtttgttccgagtataaaagcaggtaatgatatagcagcttgcctgagaaaaaatggaaagaaagtgatacaactcagtaggaagacctttgattctgaatacatcaagaccaggaccaatgattgggactttgtggtcacgactgacatttcagaaatgggtgctaacttcaaggctgaaagggttatagaccccaggcgctgcatgaaaccagtcatactaacggacggtgaagagcgggtgatcctggcaggacccatgccagtgacccactctagtgcagcacaaagaagagggagaataggaagaaatccaaaaaatgaaaatgaccagtacatatacatgggggaacctctggaaaatgatgaagactgcgcacactggaaagaagccaagatgcttttagacaacatcaacacgcctgaaggaatcattcccagcatgttcgaaccagagcgtgaaaaggtggatgctattgatggtgaataccgcttaagaggagaagcgaggaaaacctttgtggatctaatgagaagaggagacctaccagtctggctggcctacagagtggcagccgaaggcattaactatgcagacagaaggtggtgttttgatggaatcaagaacaaccaaatcttagaagaaaatgtggaagtggaaatctggacaaaagaaggggaaaggaagaaactgaaacccagatggctggatgctcggatctactctgacccactggcgctcaaagaattcaaagagtttgcagctggaagaaaatccctgaccctgaatttaatcacagaaatgggtaggcttccaacttttatgactcagaaagcaaggaacgcactggacaacttagcagtcctgcatacggctgaagcaggcggaagggcgtacaatcatgctctcagtgaactgccagagactctggagacattgcttttgctgacacttttggccacagtcacgggcggaatctttctattcttgatgagtggcaaaggtatagggaaaatgaccctgggaatgtgctgcataatcacggccagtattctcctatggtacgcacaaatacagccacactggatagcagcttcaataatactggagttttttctcatagtcttgctcattccagagccagaaaagcaaagaacaccccaagataaccaattgacttacgttgtcatagccatcctcacagtggtggccgcaaccatggcaaatgagatggggttcctggaaaaaacgaagaaagatttcggattgggaagcattgcaacccagcaacccgagagcaacatcctggacatagatctacgtcctgcatcagcatggaccctgtatgcagtggccacaacatttatcacaccaatgttgagacatagcattgaaaattcctcagtgaacgtgtctctaacagccattgctaatcaagccacagtgctaatgggtcttgggaaaggatggccattgtcgaaaatggacattggagttccccttctcgccatcgggtgctattcacaagtcaaccccataaccctcacagcagcccttcttttattggtagcacattacgctatcatagggccaggactccaagcgaaagcaaccagagaagcgcagaaaagagcagcagcaggcatcatgaagaacccaactgcggatggaataacagtgattgacctagatccaataccctatgacccaaaatttgagaagcagctgggacaagtaatgctcctagtcctctgcgtgactcaagtactgatgatgaggactacatgggctttgtgtgaggctctaaccttagcgaccgggcccatctccacattgtgggaaggaagtccagggagattctggaatacaaccattgcagtgtcaatggctaacatctttagaggaagttacctggctggagctggacttctcttttccatcatgaagaacacaaccaacacaagaaggggaactggcaacacaggagagacgcttggagagaaatggaaaaaccgattgaattcattggggaagagtgaattccagatttacaagaggagcggaattcaggaagtggatagaaccttggcaaaagaaggcattaaaagaggagaaacggaccatcatgctgtgtcgcggggctcagcaaagctgagatggttcgtcgagagaaacctggttacaccagaggggaaagtagtggacctcggttgcggtagagggggctggtcatactattgtgggggtctaaagaatgtaagagaagtcagaggcctaacaaaaggaggaccaggacacgaagaacccattcccatgtcaacatatgggtggaatcttgtgcgtctccaaagtggagttgatgtcttctttactccaccagaaaaatgtgacacattgttgtgtgatataggggagtcgtcaccaaatcccacggttgaagctggacggacactcagagtcctaaacttggtagaaaattggctgaacaacaacacccaattttgcataaaggttcttaacccatacatgccctcagtcatagaaaaaatggaaacgctgcaaaggaaatacggaggagctttggtgaggaatcccctctcaagaaattccacacatgagatgtattgggtatccaatgcttccgggaacatagtgtcatcagtgaacatgatttcaaggatgttgatcaatagatttacaatgagacataagaaggccacatacgagccagatgttgacctcggaagcggaacccgcaatatcggaatcgaaagtgagacaccaaacctagacataattgggaaaagaatagaaaaaataaaacaagagcatgagacatcatggcactatgaccaagaccacccatataaaacttgggcctaccatggcagctacgaaacaaaacagactggatcagcatcatccgtggtgaatggagtagttagactgctgacaaaaccttgggacgtcatccctatggtgacacagatggcaatgacagacacgaccccatttggacaacagcgtgttttcaaagagaaagtggacacgagaacccaagaaccgaaagaaggcacgaagaaactaatgaaaatcacggccgaatggctctggaaagaactagggaagaaaaagacacctagaatgtgcactagagaagaattcgcaagaaaggtgagaagcaatgcagccctaggtgccatattcactgatgagaacaagtggaagtcggcacgtgaggctgttgaagacagtagattttgggaactagttgacaaggaaaggaatctccatcttgaaggaaagtgtgagacatgtgtgtacaacatgatgggaaagagagagaagaagataggggaattcggcaaagcaaaaggcagcagagccgtatggtacatgtggcttggagcacgcttcttagagtttgaagccctaggatttctgaatgaagatcactggttttccagagagaactctctgagcggagtggaaggagaagggctgcacaagctgggttacattctaagagaagtgagcaagaaagaaggaggagcaatgtacgccgacgacacagcaggatgggatacaagaatcacgctagaggacctaaaaaatgaagagatggtaacaaaccatatggaaggagaacacaagaaacttgctgaggccatcttcaaattaacgtaccaaaacaaggtggtgcgtgtgcaaagacccacaccaagaggcacagtaatggatattatatcgagaagagaccaaagaagtagtggacaagttggcacctatggcctcaacacctttaccaatatgggagcccaactaatcagacagatggagggagagggagtctttaaaggcatccagcatctgacagccacagaagaagttgcagtgcaagactggttagcaagagtggggcgtgagaggttatcaagaatggccatcagtggagatgattgtgttgtgaaacccttagatgacaggtttgcaagcgctttaacagctctaaatgacatgggaaaggttaggaaagacatacaacaatgggaaccttcaagaggatggaacgactggacacaagtgcctttctgttcacaccatttccatgagttaatcatgaaagacggtcgtgtgctcgtagttccatgtagaaaccaagatgaactgattggtagagctcgaatttcccagggagccgggtggtctttgcgggagacggcctgtctggggaagtcttacgcccaaatgtggagcctgatgtacttccacagacgtggcctcaggctggcagcaaacgctatttgctcggcagttccatcacattgggtcccgacaagtcgaacaacctggtccatacacgccagacatgagtggatgacaacagaagacatgctgacagtctggaacagggtgtggattcaagaaaacccatggatggaagacaaaactccagtggaatcatgggaggaaatcccatacttggggaaaagaggagaccaatggtgcggctcattgatagggttaacaagcagggccacctgggcaaggaacatccaaacagcaataaaccgagttagatccttaataggcagtgagggatacacagactacatgccatccatgaaaagattcagaagagaagaggacgaggcaggggtcttgtggtag

SEQ ID NO: 6683 - RNA, 9876 nt, synthetic construct
  misc_feature 1..9876: note = derived and/or modified CDS sequence (wt) from DENV-2__KJ010185__SS-prME
  source 1..9876: mol_type = other RNA
accgcaggcgtgatcatcatgctgattccaacagcgatggcgttccatttaaccacacgcaacggagaaccacacatgatcgtcagcaaacaggagaaagggaaaagtctcttgtttaaaacagaggatggtgtgaacatgtgcaccctcatggccatggaccttggtgaactgtgtgaagacacaatcacttataactgtcctcttctcaggcagaatgaaccagaagatatagattgttggtgtaacgccacgtccacatgggtaacttatgggacatgcactgccacaggagaacacagaagggaaaaaagatcagtggcacttgtcccacatgtgggaatgggattggagacacgaactgaaacgtggatgtcatcagaaggggcctggaaacacgcccagaggattgaaacctggatcttgagacatccaggttttaccataatggcagcaatcttggcatacaccataggaacgacatatttccaaagagtcctgatattcatcttactgacagctgtcgctccttcaatgacaatgcgttgtattggaatatcaaatagagacttcgtggaaggggtttcaggaggaagctgggttgacatagtcttagaacatggaagctgtgtgacaacgatggcaaaaaacaaaccaacattggactttgaactgataaaaacagaagccaagcaacctgccactctaaggaagtactgtatagaggcaaagctgaccaacacaacaacagcatctcgatgcccaacacaaggggaacccagcctaaatgaagaacaggacaaaaggtttgtctgcaaacattccatggtagacagaggatggggaaatggatgtggattatttggaaagggaggcattgtgacctgtgctatgttcacatgcaagaaaaacatggaagggaaaattgtgcaaccagaaaacctggaatacaccattgtggtaacacctcattcaggggaagagaatgcagttggaaacgacacaggaaaacatggcaaggaaatcaaagtgacaccacagagttccattacagaagcagaactgacaggctacggcactgtcacgatggagtgctctccaagaacgggcctcgacttcaatgagatggtgttgctgcaaatggaaaacaaggcttggctggtgcacaggcaatggttcctagacctgccgttaccatggttgcccggagcggacatacaaggatcaaattggatacagaaggagacgttggtcaccttcaaaaatccccatgcgaagaaacaggatgttgttgttttaggatcccaagaaggggctatgcatacagcacttacaggggccacggaaatccagatgtcatcaggaaacccactgttcacaggacatctcaagtgcaggctgagaatggataaattacagctcaaaggaatgtcatactctatgtgtacaggaaagtttaaagttgtaaaggaaatagcagaaacacaacatggaacaatagttgtcagaatacaatatgaaggggatggctctccatgtaaaatcccttttgagataatggatttggaaaaaagacatgtcttaggtcgcctgattacagtcaacccaatcgtcacagaaaaagacagtccagtcaacatagaagcagaacccccattcggagacagctacatcattataggagtagaaccgggacaactgaagctcagctggtttaagaaaggaagctcaatcggccaaatgttcgagacaacaatgagaggagcgaagagaatggccattttaggtgacacagcctgggattttggatccctgggaggagtgttcacatctataggaaaggccctccaccaagtttttggagcaatctatggggctgccttcagtggggtttcatggactatgaaaatcctcataggagttgtcatcacatggataggaatgaattcacgtagcacctcactgtctgtgtcactagtattagtgggagtcgtgacattgtacttgggagttatggtgcaggctgatagtggttgtgttgtgagttggaaaaacaaagaactgaaatgtggcagtgggattttcttcacagacaatgtacacacatggacagaacaatacaaattccaaccagaatccccctcaaagctggcttcagctatccagaaagctcatgaagaaggcatttgtggaatccgctcaataacaagactggataatctaatgtggaaacaaataacaccagaactgaatcacattctatcagaaaatgaggtaaagttgtctatcatgacaggggacatcaaaggaatcatgcaggcaggaaaacgatccctgcggcctcagcccactgagctgaaatattcatggaaaacgtggggcaaagcgaaaatgctctccacagagcctcataaccagacctttctcattgatggccccgaaacagcacaatgtcccaacacaaacagagcttggaactcactagaagttgaagactatggctttggggtattcaccaccaacatatggctgaagttgaaagaaaggcaggatgtgttttgtgactcaaaactcatgtcagcggccataaaagacaacagagccgtccatgccgatatgggttattggatagaaagcgcacttaatgacacatggaagatagaaaaagcttcttttatcgaagttaaaagttgccactggccaaaatcacacactctctggagtaacggagtgctagaaagtgagatgataattccaaagaattttgctggaccagtatcgcaacacaattacagaccaggctatcacacacaaacggcaggaccttggcatctaggcaagcttgagatggactttgatttttgcgaaggaaccacagtggtggtgactgaggactgcggaaatagaggaccctctctaagaacaactactgcttctggaaaactcataacagaatggtgctgccgatcctgcacattaccaccactaagatacagaggcgaggatggatgctggtacggaatggaaatcagaccattgaaagagaaagaagagaacttggtcaattctttggtcacagccggacatggacagattgacaacttctcactaggagtcttgggaatggcactgttcctggaagaaatgctcaggacccgagtaggaacaaaacatgcagtattactggttgcagtttctttcatgacattgatcacagggaacatgtctttccgagacctggggagagtgatggttatggtgggggccgctatgacggatgacataggtatgggcgtgacttatcttgccttactagcagccttcaaagttagaccaacttttgcagctggactgcttttgagaaagctgacctccaaggaattgatgatgaccaccataggaatcgtactcctctcccagagcaccacaccagagactatacttgaactgactgatgcgttggctttgggcatgatgattctcaagatagtgagaaacatggaaaagtatcaattggcagtgactatcatggctatcttatgtgttccaaatgcagtgatattacaaaatgcatggaaagtgagctgcacaatactggcagcggtgtccgtatccccactgctcttaacatcttcgcagcagaaagcggattggataccattggcattgacgatcaaaggtctcaatccaacagctattttcctaacaaccctttcaagaactaacaagaaaaggagttggccactaaatgaggctatcatggcagtcgggatggtgagcattttagctagttctctcttgaagaatgacattcccatgacaggaccattagtggctggagggcttctcactgtgtgttacgtgctcactggaagatcggccgacctggaactagagagagccgccgacgttagatgggaagatcaggcagaaatatcaggaagtagtccaattctgtcaataacaatatcggaagatggcagcatgtcgataaaaaatgaagaggaagaacaaacactgaccatactcattagaacaggattgctggtgatatcaggacttttccccgtatcaataccaatcacggcagcagcatggtacctgtgggaagtgaagaaacaacgggctggagtattgtgggatgttccttcacccccacctgtgggaaaggccgaactggaagatggagcttacagaatcaagcagaaagggattcttggatactcccagatcggagctggagtttacaaagaaggaacattccacacaatgtggcacgtcacacgtggtgctgttctaatgcacaaagggaagaggattgaaccatcatgggcggatgtcaggaaagacctaatatcgtatggaggaggctggaagctagaaggagaatggaaggaaggagaagaagtccaggtcttggcattagagcctggaaagaatccaagagccgtccaaacaaaacccggtctttttaagactaacaccggaaccataggcgctgtgtccctagacttttctcctggaacgtcaggatctccaatcgtcgacaaaaaaggaaaagtcgtgggtctctatggtaatggtgtcgtcacaaggagtggaacatatgtgagtgccatagcccagactgaaaaaagcattgaagacaatccagagattgaagacgatatctttcgaaaaaaaagattgaccattatggacctccacccaggagcgggaaagacgaaaagataccttccagcaatagttagagaggccataaaacgaggcttaagaacattaatcctggcccccactagagtcgtggcagctgaaatggaggaagctcttagaggacttccaataagataccaaaccccagccatcagagctgagcacactgggcgagaaatcgtggatttaatgtgtcatgccacatttaccatgaggctgttatcaccagttagagtgccaaattacaacttgatcattatggatgaagcccatttcacagacccagcaagcatagcagctagaggatacatttcaactcgagtagaaatgggtgaagcagctgggattttcatgacagccactcccccgggaagcagagacccatttcctcaaagcaatgcaccaatcatggatgaagagagggaaatccctgaacgttcgtggaactctggacatgagtgggttacagatttcaaagggaagactgtttggtttgttccgagcataaaagcaggtaatgatatagcagcttgcctgagaaaaaatggaaagaaagtgatacaactcagtaggaagacctttgattctgaatacattaagaccaggaccaatgattgggactttgtggtcacgactgacatttcagaaatgggtgctaacttcaaggctgaaagggttatagaccccaggcgctgcatgaaaccagtcatactaacggacggtgaagagcgggtgatcctggcaggacccatgccagtgacccactctagtgcagcacaaagaagagggagaataggaagaaatccaaaaaatgaaaatgaccagtacatatacatgggggaacctctggaaaatgatgaagactgcgcacactggaaagaagccaagatgcttttagacaacatcaacacgcctgaaggaatcattcccagcatgttcgaaccagagcgtgaaaaggtggatgctattgatggtgaataccgcttaagaggagaagcgaggaaaacctttgtggatctaatgagaagaggagacctaccagtctggctggcctacagagtggcagccgaaggcattaactatgcagacagaaggtggtgttttgatggaatcaagaacaaccaaatcttagaagaaaatgtggaagtggaaatctggacaaaagaaggggaaaggaagaaactgaaacccagatggctggatgctcggatctactctgacccactggcgctcaaagaattcaaagagtttgcagctggaagaaaatccctgaccctgaatttaatcacagaaatgggtaggctcccaacttttatgactcagaaagcaaggaacgcactggacaacttagcagtcctgcatacggctgaagcaggcggaagggcgtacaaccatgctctcagtgaactgccagagactctggagacattgcttttgctgacacttttggccacagtcacgggcggaatctttttatttttgatgagtggcaaaggtatagggaaaatgaccctgggaatgtgctgcataatcacggccagtattctcctatggtacgcacaaatacagccacactggatagcagcttcaataatactggagttttttctcatagtcttgctcattccagagccagaaaagcaaagaacaccccaagataaccaattgacttacgttgtcatagccatcctcacagtggtggccgcaaccatggcaaatgagatggggttcctggaaaaaacgaagaaagatttcggactgggaagcattgcaacccagcaacccgagagcaacatcctggacatagatctacgtcctgcatcagcatggaccctgtatgcagtggccacaacatttatcacaccaatgttgagacatagcattgaaaattcctcagtgaacgtgtctctaacagccattgctaatcaagccacagtgctaatgggtcttgggaaaggatggccattgtcgaagatggacattggagttccccttctcgccatcgggtgctattcacaagtcaaccccataaccctcacagcagcccttcttttattggtagcacattacgctatcatagggccaggactccaagcgaaagcatccagagaagcgcagaaaagagcagcagcaggcatcatgaaaaacccaactgtggatggaataacagtgattgacctagatccaataccctatgacccaaaatttgagaagcagctgggacaagtaatgctcctaatcctctgcgtgactcaagtactgatgatgaggactacatgggctttgtgcgaggctctaaccttagcgaccgggcccatctccacattgtgggaaggaaatccagggagattctggaatacaaccattgcagtgtcaatggctaacatttttagaggaagttacctagctggagctggacttctcttttccatcatgaagaacacaaccaacacaagaaggggaactggcaacacaggagagacgcttggagagaaatggaaaaaccgagtgtcattgttggggaagagtgaattccagatttacaagagaagcggaattcaggaagtggatagaaccttggcaaaagaaggcattaaaagaggagaaacggaccatcatgctgtgtcgcgaggctcagcaaagctgagatggttcgtcgagagaaacctggttacaccagaggggaaagtagtggacctcggttgcggtagagggggctggtcatactattgtgggggtctaaagaatgtaagagaagtcaaaggcctaacaaaaggaggaccaggacacgaagaacccattcccatgtcaacatatgggtggaatcttgtgcgtctcctaactggagctgatgttttctttactccaccagaaaaatgtgacacattgttgtgtgatataggggagtcgtcaccaaatcccacggttgaagctggacgaacactcagagtcctaaacttggtagaaaattggctgaacaacaacacccaattttgtataaaggttcttaacccatacatgccctcagtcatagaaaaaatggaaacgctgcaaaggaaatacggaggagctttggtgaggaatcccctctcaagaaattccacacatgagatgtattgggtatccaatgcttccgggaacatagtgtcatcagtgaacatgatttcaaggatgttgatcaatagatttacaatgagacataagaaggccacatacgacccagatgttgacctcggaagcggaacccgcaacatcggaatcgaaagtgaaacaccaaacctagacataattgggaaaagaatagaaaaaataaaacaagagcatgagacatcacggcactatgaccaagaccacccatataaaacttgggcctaccatggcagctacgaaacaaaacagactggatcagcatcatccacggtgaatggagtagttagactgctgacaaaaccttgggacgtcatccctatggtgacacagatggcaatgacagacacgaccccatttggacaacagcgtgttttcaaagagaaagtggacacgagaacccaagaaccgaaagaaggcacgaagaaactaatgaaaatcacggccgaatggctctggaaagaactagggaagaaaaagacacctagaatgtgcactagagaagaattcgcaagaaaggtgagaagcaatgcagccctaggtgccatattcactgatgagaacaagtggaagtcggcacgtgaggctgttgaagacagtagattttgggaactagttgacaaggaaaggaatctccatcttgaaggaaagtgtgagacatgtgtgtacaacatgatgggaaagagagagaagaagataggggaattcggcaaagcaaaaggcagcagagccatatggtacatgtggcttggagcacgcttcttagagtttgaagccctaggatttctgaatgaagatcactggttttccagagagaactctctgagcggagtggaaggagaagggctgcacaagctgggttacattctaagagaagtgagcaagaaagaaggaggagcaatgtacgccgacgacacagcaggatgggatacaagaatcacactagaggacctaaaaaatgaagagatggtaacaaaccatatggaaggagaacacaagaaacttgctgaggccatcttcaaattaacgtaccaaaacaaggtggtgcgtgtgcaaagacccacaccaagaggcacagtaatggatattatatcgagaagagaccaaagaggtagtgtacaagttggtacctatgggctcggcacctttaccaatatgggagcccaactaatcagacagatggagggagagggagtctttaaaggcatccagcatctgacagccacagaagaagttgcagtgcaagactggttagcaagagtggggcgtgagaggttatcaagaatggccatcagtggagatgattgtgttgtgaaacccttagatgacaggtttgcaagcgctttaacagctctaaatgacatgggaaaggttaggaaagacatacaacaatgggaaccttcaagaggatggaacgactggacacaagtgcctttctgttcacaccatttccatgagttaatcatgaaagacggtcgtgtgctcgtagttccatgtagaaaccaagatgaactgattggtagagctcgaatttcccagggagccgggtggtctttgcgggagacggcctgtctggggaagtcttacgcccaaatgtggagcctgatgtacttccacagacgtgacctcaggctggcagcaaatgctatttgctcggcagttccatcacattgggttccgacaagtcgaacaacctggtccatacacgccggacatgaatggatgacaacagaagacatgctgacagtctggaacagggtgtggattcaagaaaacccatggatggaagacaaaactccagtggaatcatgggaggaaatcccatacttggggaaaagagaagaccaatggtgcggctcattgatagggttaacaagcagggccacctgggcaaggaacatccaaacagcaataaaccaagttagatccttaataggcagtgaggaatacacagactacatgccatccatgaaaagattcggaagagaagaggaagaggcaggggtcttgtggtag

SEQ ID NO: 6684 - RNA, 9876 nt, synthetic construct
  misc_feature 1..9876: note = derived and/or modified CDS sequence (wt) from DENV-2__KJ010186__SS-prME
  source 1..9876: mol_type = other RNA
accgcaggcgtgatcatcatgctgattccaacagcgatggcgttccatttaaccacacgcaacggagaaccacacatgatcgtcagcaaacaggagaaagggaaaagtctcttgtttaaaacagaggatggtgtgaacatgtgcaccctcatggccatggaccttggtgaactgtgtgaagacacaatcacttataactgtcctcttctcaggcagaatgaaccagaagatatagattgttggtgtaacgccacctccacatgggtaacttatgggacatgcactgccacaggagaacacagaagggaaaaaagatcagtggcacttgtcccacatgtgggaatgggattggagacacgaactgaaacgtggatgtcatcagaaggggcctggaaacacgcccagaggattgaaacctggatcttgagacatccaggtttcaccataatggcagcaatcttggcatacaccataggaacgacatatttccaaagagtcctgatattcatcttactgacagctgtcgctccttcaatgacaatgcgttgtattggaatatcaaatagagactttgtggaaggggtttcaggaggaagctgggttgacatagtcttagaacatggaagctgtgtgacaacgatggcaaaaaacaaaccaacattggactttgaactgataaaaacagaagccaagcaacctgccactctaaggaagtactgcatagaggcaaggctgaccaacacaacaacagcatctcgatgcccaacacaaggggaacccagcctaaatgaagaacaggacaaaaggtttgtctgcaaacattccatggtagacagaggatggggaaatggatgtggattatttggaaagggaggcattgtgacctgtgctatgttcacatgcaaaaaaaacatggaagggaaaattgtgcaaccagaaaacctggaatacaccattgtggtaacacctcattcaggggaagagaatgcagttggaaatgacacaggaaaacatggcaaggaaatcaaagtgacaccacagagttccattacagaagcagaactgacaggctacggcactgtcacgatggagtgctctccaagaacgggcctcgacttcaatgagatggtgttgctgcaaatggaaaacaaggcttggctggtgcacaggcaatggttcttagacctgccgttaccatggctgcccggagcggacatacaaggatcaaattggatacagaaggagacgttggtcaccttcaaaaaaccccatgcgaagaaacaggatgttgttgttttaggatcccaagaaggggctatgcatacagcacttacaggggccacggaaatccagatgtcatcaggaaacctactgttcacaggacatctcaagtgcaggctgagaatggataaattacagctcaaaggaatgtcatactctatgtgtacaggaaagtttaaagttgtaaaggaaatagcagaaacacaacatggaacaatagttgtcagagtacaatatgaaggggatggctctccatgtaaaatcccttttgagataatggatttggaaaaaagacatgtcttaggtcgtctgattacagtcaacccaatcgtcacagaaaaagacagtccagtcaacatagaagcagaacccccattcggagacagctacatcattataggagtagaaccgggacaactgaagctcagctggtttaagaaaggaagctcaatcggccaaatgttcgaaacaacaatgagaggagcgaagagaatggccattttaggtgacacagcctgggattttggatccctgggaggagtgttcacatctataggaaaggccctccaccaagtttttggagctatctatggggctgccttcagtggggtttcatggactatgaaaatcctcataggagttgtcatcacatggataggaatgaattcacgtagcacctcactgtctgtgtcactagtattagtgggagtcgtgacattgtacttgggagttatggtgcaggctgatagtggttgtgttgtgagttggaaaaacacagcactgaaatgtggcagtgggattttcatcacagacaatgtacacacatggacagaacaatacaaattccaaccagaatccccctcaaagctggcttcagctatccagaaagctcatgaagaaggcatttgtggaatccgctcagtaacaagattggagaatctaatgtggaaacaaataacaccagaactgaatcacatcctatcagaaaatgaggtaaagttgtctatcatgacaggggacatcaaaggaatattgcaggcaggaaaacgatccctgcggcctcagcccactgagctgaaatattcatggaaaacgtggggcaaagcgaaaatgctctccacagagtctcataaccagacctttctcattgatggccccgaaacagcagaatgtcctaacacaaacagagcttggaactcactagaagttgaagactatggctttggggtattcaccaccaacatatggctgaagttgaaagaaaggcaggatgtgttttgtgactcaaaactcatgtcagcggccataaaagacaacagagccgtccatgccgatatgggttattggatagaaagcgcacttaatgacacatggaagatagaaaaagcttctttcatcgaagttaaaagttgccactggccaaaatcacacactctctggagtaacggagtgctagaaagtgagatgataattccaaagaattttgctggaccagtatcgcaacataattacagaccaggctatcacacacaaacggcaggaccttggcatctaggcaagcttgagatggactttgatttttgcgaaggaaccacagtggtggtgactgaggactgcggaaatagaggaccctctctaagaacaactactgcttctggaaaactcataacagaatggtgctgccgatcctgcacattaccaccactaagatacagaggcgaggatggatgctggtacggaatggaaatcagaccattgaaagagaaagaagagaacttggtcaattctttggtcacagccggacatgggcagattgacaacttctcactaggagtcttgggaatggcactgttcctggaagaaatgctcaggacccgagtaggaacaaaacatgcagtattactggttgcagtttctttcatgacattgatcacagggaacatgtctttccgagacctggggagagtgatggttatggtgggggccgctatgacggatgacataggtatgggcgtgacttatcttgccttactagcagccttcaaagttagaccaacttttgcagctggactgcttttgagaaagctgacctccaaggaattgatgatgaccaccataggaatcgtactcctctcccagagcaccacaccagagactatactcgaactgactgatgcgttggctttgggcatgatgattctcaagatagtgagaaacatggaaaagtatcaactggcagtgactatcatggctatcttatgtgttccaaatgcagtgatattacaaaatgcatggaaagtgagctgcacaatactggcagcggtgtccgtatccccactgctcttaacatcttcgcagcagaaagcggattggataccattggcattgacgatcaaaggtctcaatccaacagccatttttctaacaaccctttcaagaactaacaagaaaaggagttggccactaaatgaggctatcatggcagtcgggatggtgagcattttagctagttctctcttgaagaatgacattcccatgacaggaccattagtggctggagggcttctcactgtgtgttacgtgctcactggaagatcggccgacctggaactagagagagccgccgacgttagatgggaagatcaggcagaaatatcaggaagtagtccaattctatcaataacaatatcggaagatggcagcatgtcgataaaaaatgaagaggaagaacaaacactgaccatactcattagaacaggattgctggtgatatcaggacttttccccgtatcaataccaatcacggcagcagcatggtacctgtgggaagtgaagaaacaacgggctggagtattgtgggatgttcgttcatacccacctgtgggaaaggccgaactggaagatggagcctacagaatcaagcagaaagggattcttggatactcccagatcggagctggagtttacaaagaaggaacattccacacaatgtggcacgtcacacgtggcgctgttctaatgcacaaagggaagaggattgaaccatcatgggcggatgtcaggaaagacctaatatcgtatggaggaggctggaagctagaaggagaatggaaggaaggagaagaagtccaggtcttggcattagagcctggaaagaatccaagagccgtccaaacaaaacccggtctttttaagactaacactggaaccataggcgctgtgtccctagacttttctcctggaacgtcaggatctccaatcgtcgacaaaaaaggaaaagtcgtgggtctctatggtaatggtgtcgtcacaaggagtggaacatatgtgagtgccatagcccagactgaaaaaagcattgaagacaatccagagattgaagatgatatctttcgaaaaaaaagattgaccattatggacctccacccaggagcgggaaagacgaaaagataccttccagcaatagttagagaggccataaaacgaggcttaagaacattaatcctggcccccactagagttgtggcagctgaaatggaagaagctcttagaggacttccaataagataccaaaccccagccatcagagctgagcacactgggcgagaaatcgtggatttaatgtgccatgccacatttaccatgaggctgttatcaccagttagagtgccaaattacaacttgatcattatggatgaagcccatttcacagacccagcaagcatagcagctagaggatacatttcaactcgagtagagatgggtgaagcagctgggattttcatgacagccactcccccgggaagcagagacccatttcctcaaagcaatgcaccaatcatggatgaagagagggaaatccctgaacgttcgtggaactctggacatgagtgggttacagatttcaaagggaagactgtttggtttgttccgagcataaaagcaggtaatgatatagcagcttgcctgagaaaaaatggaaagaaagtgatacaactcagtaggaagacctttgattctgaatacattaagaccaggaccaatgattgggactttgtggtcacgactgacatttcagaaatgggtgctaacttcaaggctgaaagggttatagaccccaggcgctgcatgaaaccagtcatactaacggacggtgaagagcgggtgatcctggcaggacccatgccagtgacccactctagtgcagcacaaagaagagggagaataggaagaaatccaaaaaatgaaaatgaccagtacatatacatgggggaacctctggaaaatgatgaagactgcgcacactggaaagaagccaagatgcttttagacaacatcaacacgcctgaaggaatcattcccagcatgttcgaaccagagcgtgaaaaggtggatgctattgatggtgaataccgcttaagaggagaagcgaggaaaacctttgtggatctaatgagaagaggagacctaccagtctggctggcctacagagtagcagccgaaggcattaactatgcagacagaaggtggtgttttgatggaatcaagaataaccaaatcttagaagaaaatgtggaagtggaaatctggacaaaagaaggggaaaggaagaaactgaaacccagatggctggatgctcggatctactctgacccactggcgctcaaagaattcaaagagtttgcagctggaagaaaatccctgaccctgaatttaatcacagaaatgggtaggcttccaacttttatgactcagaaagcaaggaacgcactggacaacttagcagtcctgcatacggctgaagcaggcggaagggcgtacaaccatgctctcagtgaactgccagagactctggagacattgcttttgctgacacttttggccacagtcacgggcggaatctttttatttttgatgagtggcaaaggtatagggaaaatgaccctgggaatgtgctgcataatcacggccagcattctcctatggtacgcacaaatacagccacactggatagcagcttcaataatactggagttttttctcatagtcttgctcattccagagccagaaaagcaaagaacaccccaagataaccaattgacttacgttgtcatagccatcctcacagtggtggccgcaaccatggcaaatgagatggggttcctggaaaaaacgaagaaagatttcggactgggaagcattgcaacccagcaacccgagagcaacatcctggacatagatctacgtcctgcatcagcatggaccctgtatgcagtggccacaacatttatcacaccaatgttgagacatagcattgaaaattcctcagtgaacgtgtctctaacagccattgccaaccaagccacagtgctaatgggtcttgggaaaggatggccattgtcgaagatggacattggagttccccttctcgccatcgggtgctattcacaagtcaaccccataaccctcacagcagcccttcttttattggtagcacattacgctatcatagggccaggactccaagcgaaagcaaccagagaagcgcagaaaagagcagcagcaggcatcatgaaaaacccaactgtggatggaataacagtgattgacctagatccaataccctatgacccaaaatttgagaagcagctgggacaagtaatgctcctagtcctctgcgtgactcaagtactgatgatgaggactacatgggctttgtgtgaggctctaaccttagcgaccgggcccatctccacattgtgggaaggaaatccagggagattctggaatacaaccattgcagtgtcaatggctaacatttttagaggaagttacctagctggagctggacttctcttttccatcatgaagaacacaaccaacacaagaaggggaactggcaacacaggagagacgcttggagagaaatggaaaaaccgattgaattcattggggaagagtgaattccagatttacaagagaagcggaattcaggaagtggatagaaccttggcaaaagaaggcattaaaagaggagaaacggaccatcatgctgtgtcgcgaggctcagcaaagctgagatggttcgtcgagagaaacctggttacaccagaggggaaagtagtggacctcggttgcggtagagggggctggtcatactattgtgggggtctaaagaatgtaagagaagtcaaaggcctaacaaaaggaggaccaggacacgaagaacccattcccatgtcaacatatgggtggaatcttgtgcgtctccaaagtggagttgatgttttctttactccaccagaaaaatgtgacacattgttgtgtgatataggggagtcgtcaccaaatcccacggttgaagctggacgaacactcagagtcctaaacttggtagaaaattggctgaacaacaacacccaattttgcataaaggttcttaacccatacatgccctcagtcatagaaaaaatggaaacgctgcaaaggaaatacggaggagctttggtgaggaatcccctctcaagaaattccacacatgagatgtattgggtatccaatgcttccgggaacatagtgtcatcagtgaacatgatttcaaggatgttgatcaatagatttacaatgagacataagaaggccacatacgagccagatgttgacctcggaagcggaacccgcaacatcggaatcgaaagtgagacaccaaacctagacataattgggaaaagaatagaaaaaataaaacaagagcatgagacatcatggcactatgaccaagaccacccatataaaacgtgggcctaccatggcagctacgaaacaaaacagactggatcagcatcatccatggtgaatggagtagttagactgctgacgaaaccttgggacgtcattcctatggtgacacagatggcaatgacagacacgaccccatttggacaacagcgtgttttcaaagagaaagtggacacgagaacccaagaaccgaaagaaggcacgaagaaactaatgaaaatcacggccgaatggctttggaaagaactagggaagaaaaagacacctagaatgtgcactagagaagaattcgcaagaaaggtgagaagcaatgcagccctaggtgccatattcactgatgagaacaagtggaagtcggcacgtgaggctgttgaagacagtagattttgggaactagttgacaaggaaaggaatctccatcttgaaggaaagtgtgagacatgtgtgtacaacatgatgggaaagagagagaagaagataggggaattcggcaaagcaaaaggcagcagagccatatggtacatgtggcttggagcacgcttcttagagtttgaagccctaggatttctgaatgaagatcactggttttccagagagaactctctgagcggagtggaaggagaagggctgcacaagctgggttacattctaagagaagtaagcaagaaagaaggaggagcaatgtacgccgacgacacagcaggatgggatacaagaatcacactagaggacctaaaaaatgaagagatggtaacaaaccatatggaaggagaacacaagaaacttgctgaggccatcttcaaattaacgtaccaaaacaaggtggtgcgtgtgcaaagacccacaccaagaggcacagtaatggatattatatcgagaagagaccaaagaggtagtggacaagttggcacctatggcctcaacacctttaccaatatgggagcccaactaatcagacagatggagggagagggagtctttaaaggcatccagcatctgacagccacagaagaagttgcagtgcaagactggttagcaagagtggggcgtgagaggttatcaagaatggccatcagtggagatgattgcgttgtgaaacccttagatgacaggtttgcaaacgctttaacagctctaaatgacatgggaaaggttaggaaagacatacaacaatgggaaccttcaagaggatggaacgactggacacaagtgcctttctgttcacaccatttccatgagttaatcatgaaagacggtcgtgtgctcgtagttccatgtagaaaccaagatgaactgattggtagagctcgaatttcccagggagccgggtggtctttgcgggagacggcctgtctggggaagtcttacgcccaaatgtggagcctgatgtacttccacagacgtgacctcaggctggcagcaaacgctatttgctcggcagttccatcacactgggttccgacaagtcgaacaacctggtccatacacgccagacatgaatggatgacaacagaagacatgctgacagtctggaacagggtgtggattcaagaaaacccatggatggaagacaaaactccagtggaatcatgggaggaaatcccatacttggggaaaagagaagaccaatggtgtggctcattgatagggttaacaagcagggccacctgggcaaggaacatccaaacagcaataaaccaagttagatccttaataggcagtgaggaatacacagactacatgccatccatgaaaagattcagaagagaagaggaagaggcaggggtcttgtggtag

SEQ ID NO: 6685 - RNA, 9876 nt, synthetic construct
  misc_feature 1..9876: note = derived and/or modified CDS sequence (wt) from DENV-2__KF955364__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagacacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtattgtatagaagcaaagctgaccaacacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatataccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaatccaatcgtaacagaaaaagatagcccagtcaacatagaagcagaacctccattcggagacagctacatcatcataggagtagagccgggacaactgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgcggaatccgctcagtaacaagattggagaatctgatgtggaaacaaataacaccagaattgaatcacattctttcagagaatggggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattatgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaagaattttgccgggccagtgtcacaacacaactacagaccaggctaccacacacaaacagcaggaccctggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaatatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaggttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaacatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagccgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaagaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgagccatcatgggcagacgtcaagaaagacctaatatcatatggaggaggctggaagctagaaggagaatggaaagaaggagaggaagtccaagtcttagcattggaacctggaaaaaatccaagagccgttcaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtggagatgggtgaagcagccgggattttcatgacagccactcctccgggaagtagagacccatttcctcagagcaatgcaccgatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagtatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaactaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggcttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccccataactctcacagcagctcttcttctactggtagcacattatgccattatagggccgggacttcaagcgaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtagtggacctcggttgcggcagagggggctggtcatactattgtgggggactaaagaatgtaagagaagtcaaaggcctgacaaaaggaggaccaggacatgaagaacccatccccatgtcaacatatgggtggaacctagtgcgtctgcaaagtggagttgacgttttcttcaccccgccagaaaagtgtgacacattgttgtgtgatataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctacagggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaatatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6686 - RNA, 9876 nt, synthetic construct
  misc_feature 1..9876: note = derived and/or modified CDS sequence (wt) from DENV-2__KF955372__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatttgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagtacgctgtaggtaatgacacaggaaaacatggcaaggaaattaaaataacaccacagagttccatcacagaagcagaactgacaggctatggcactgttacgatggagtgctctccgagaacgggcctcgacttcaatgaaatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgttgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacgtagaagcagaacctccattcggagacagctacatcatcataggagtagagccgggacaattgaaactcaattggttcaagaagggaagttctattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactatctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggggttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaactggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttatggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtacagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagccgcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacactggaaagaagctaaaatgctcttagataacatcaacacacctgaaggaatcattcctagtatgttcgaaccagagcgtgaaaaggttgatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggccagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattctgcataaaggttctcaacccatatatgccctcagtcatagaaaaaatggaaacactacaaaggaaatatggaggagccttggtgaggaatccactctcacgaaactccacacatgagatgtactgggtatccaatgctactgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtcgtcagactgctgacaaaaccttgggacgtcgtccctatggtgacacagatggcaatgacagacacgactccatttggacaacaacgcgttttcaaagagaaagtagacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcagagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6687 - RNA, 9876 nt, synthetic construct
  misc_feature 1..9876: note = derived and/or modified CDS sequence (wt) from DENV-2__KF955373__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagtttttggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccattatcgataccaattacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacattggagttcccctccttgccattggatgctattcacaagtcaaccctataactctcacagcagctcttcttctactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtggaggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6688 - RNA, 9876 nt, synthetic construct
  misc_feature 1..9876: note = derived and/or modified CDS sequence (wt) from DENV-2__GQ868600__SS-prME
  source 1..9876: mol_type = other RNA
actgcaggcatgatcatcatgctgattccaacagtgatggcgtttcatctgaccacacgcaacggagaaccacacatgatcgtcagtagacaagaaaaagggaaaagccttctgtttaagacaaaggacggcacgaacatgtgtaccctcatggccatggaccttggtgagttgtgtgaagacacaatcacgtataaatgtccctttctcaagcagaacgaaccagaagacatagattgttggtgcaactccacgtccacatgggtaacttatgggacatgtaccaccacaggagagcacagaagagaaaaaagatcagtggcgcttgttccacacgtgggaatgggattggagacacgaactgaaacatggatgtcatcagaaggggcctggaaacatgcccagagaattgaaacttggattctgagacatccaggctttaccataatggccgcaatcctggcatacaccataggaacgacgcatttccaaagagtcctgatattcatcctactgacagccatcgctccttcaatgacaatgcgctgcataggaatatcaaatagggactttgtggaaggagtgtcaggagggagttgggttgacatagttttagaacatggaagttgtgtgacgacgatggcaaaaaataaaccaacactggactttgaactgataaaaacagaagccaaacaacccgccaccttaaggaagtactgtatagaggctaaactgaccaacacgacaacagactcgcgctgcccaacacaaggggaacccaccctgaatgaagagcaggacaaaaggtttgtctgcaaacattccatggtagacagaggatggggaaatggatgtggattatttggaaaaggaggcatcgtgacctgtgccatgttcacatgcaaaaagaacatggaaggaaaaattgtgcagccagaaaacctggaatacactgtcgtgataacacctcattcaggggaagaacatgcagtcggaaatgacacaggaaaacatggtaaagaagtcaagataacaccacagagctccatcacagaggcggaactgacaggctatggcactgttacgatggagtgctctccaagaacgggcctcgacttcaatgagatggtgttgctgcaaatggaagacaaagcttggctggtgcacagacaatggttcctagacctaccgttgccatggctgcccggagcagacacacaaggatcaaattggatacagaaagagacactggtcaccttcaaaaatccccatgcgaaaaaacaggatgttgttgtcttaggatcccaagagggggccatgcatacagcactcacaggggctacggaaatccagatgtcatcaggaaacctgctgttcacaggacatcttaagtgcaggctgagaatggacaaattacaacttaaagggatgtcatactccatgtgcacaggaaagtttaaaattgtgaaggaaatagcagaaacacaacatggaacaatagtcattagagtacaatatgaaggagacggctctccatgcaagatcccttttgagataatggatctggaaaaaagacatgttttgggccgcctgatcacagtcaacccaattgtaacagaaaaggacagtccagtcaacatagaagcagaacctccattcggagacagctacatcatcataggagtggaaccaggacaattgaagctggactggttcaagaaaggaagttccatcggccaaatgtttgagacaacaatgaggggagcgaaaagaatggccattttgggcgacacagcctgggattttggatctctgggaggagtgttcacatcaataggaaaggctctccaccaggtttttggagcaatctacggggctgctttcagtggggtctcatggactatgaagatcctcataggagttatcatcacatggataggaatgaactcacgtagcacatcactgtctgtgtcactggtattagtgggaatcgtgacactgtacttgggagttatggtgcaggccgatagtggttgcgttgtgagctggaagaacaaagaactaaaatgtggcagtggaatattcgtcacagataacgtgcatacatggacagaacaatacaagttccaaccagaatccccttcaaaactggcttcagccatccagaaagctcatgaagagggcatctgtggaatccgctcagtaacaagactggaaaatcttatgtggaaacaaataacatcagaattgaatcatattctatcagaaaatgaagtgaaactgaccatcatgacaggagacatcaaaggaatcatgcaggtaggaaaacgatctctgcggcctcaacccactgagttgaggtattcatggaaaacatggggtaaagcgaaaatgctctccacagaactccataatcagaccttcctcattgatggtcccgaaacagcagaatgccccaacacaaacagagcttggaattcactagaagttgaggactacggctttggagtattcactaccaatatatggctaagattgagagaaaagcaggatgcattttgtgactcaaaactcatgtcagcggccataaaggacaacagagccgtccatgctgatatgggttattggatagaaagcgcactcaatgatacatggaagatagagaaagcttctttcattgaagtcaaaagttgccactggccaaagtcacacactctatggagtaatggagtgctagaaagcgagatggtaattccaaagaatttcgctggaccagtgtcacaacataataacagaccaggctatcacacacaaacagcaggaccttggcatctaggcaagcttgagatggactttgatttctgcgaagggactacagtggtggtaaccgaggactgtggaaacagagggccctctttaagaacaaccactgcctcaggaaaactcataacggaatggtgttgtcgatcttgcacactaccaccactaagatacagaggtgaggatggatgctggtacgggatggaaatcagaccattgaaagagaaagaagaaaatctggtcagttctctggtcacagccggacatgggcagattgataatttctcattaggaatcttgggaatggcactgttccttgaagaaatgctcaggactcgagtaggaacgaaacatgcaatattactagtcgcagtttctttcgtaacgttaatcacagggaacatgtcttttagagacctgggaagagtgatggttatggtgggtgccaccatgacagatgacataggcatgggtgtgacttatcttgctctactagcagctttcaaagtcagaccaacctttgcagctggactgctcttgagaaaactgacctccaaggaattaatgatgaccaccataggaatcgttcttctctcccagagtagcataccagagaccattcttgaactgaccgatgcgttagctttaggcatgatggtcctcaagatggtgagaaacatggaaaaatatcagctggcagtgactatcatggctattttgtgcgtcccaaatgctgtgatattacagaacgcatggaaagtgagttgcacaatattggcagtggtgtctgtttcccccctgctcttaacatcctcacaacagaaagcggactggataccattagcgttgacgatcaaaggcctcaatccaacagccatttttctaacaaccctctcaagaaccagcaagaaaaggagctggcctttaaatgaggccatcatggcggttgggatggtgagtatcttggccagctctctcttaaagaatgacatccccatgacaggaccattagtggctggagggcttcttactgtgtgctacgtactaactgggcggtcagccgatctggaactagagagagctaccgatgtcaaatgggatgaccaggcagagatatcaggtagcagtccaattctgtcaataacaatatcagaagatggcagcatgtcaataaagaatgaagaggaagagcaaacattgactatactcattagaacaggattgcttgtgatctcaggactctttccggtatcaataccaattacagcagcagcatggtacctgtgggaagtaaagaaacaacgggctggagtgttgtgggatgtcccctcaccaccacccgtgggaaaggctgaattggaagatggagcctacagaatcaagcaaaaaggaatccttggatattcccagatcggagctggagtttacaaagaaggaacatttcacacaatgtggcacgtcacacgtggcgctgtcctaatgcataaggggaagaggattgaaccatcatgggcggacgtcaagaaagacttaatatcatatggaggaggttggaagctagaaggagaatggaaagaaggagaagaagtccaggtcttggcattggagcctgggaaaaatccaagagccgtccaaacaaaacctggcctttttagaaccaatactggaaccataggtgccgtatctctggacttttcccctgggacgtcaggatctccaatcgtcgacaaaaaaggaaaagttgtaggtctctatggcaatggtgtcgttacaaggagtggagcatatgtgagtgccatagctcagactgaaaaaagcattgaagacaatccagagattgaagatgacatctttcgaaagagaagattgactatcatggatctccacccaggagcaggaaagacaaagagatacctcccggccatagtcagagaggccataaaaagaggcttgagaacactaatcctagcccccactagagtcgtggcagctgaaatggaggaagcccttagaggacttccaataagataccaaactccagctatcagggctgagcacaccgggcgggagattgtggacttaatgtgtcatgccacatttaccatgaggctgctatcaccaatcagggtgccaaattacaacctgatcatcatggacgaagcccattttacagatccagcaagcatagcagctaggggatacatctcaactcgagtggagatgggtgaggcagctggaatttttatgacagccactcctccgggtagcagagatccatttcctcagagtaatgcaccaattatggacgaagaaagagaaatcccggaacgttcatggaactccgggcacgagtgggtcacggattttaaaggaaagactgtctggtttgttccaagcataaaaaccggaaatgacatagcagcctgcctgagaaagaatggaaagagggtgatacaactcagtaggaagacctttgattctgaatatgtcaagactagaaccaatgactgggatttcgtggttacaactgacatctcggaaatgggtgccaactttaaagctgagagggttatagaccccagacgctgcatgaaaccagttatactgacagacggcgaagagcgggtgattctggcaggacccatgccagtgacccactctagtgcagcacaaagaagagggagaataggaaggaatccaaggaatgaaaatgatcaatatatatatatgggggaacccctggaaaatgatgaagactgtgcgcactggaaggaagctaagatgctcctagataacatcaacacacctgaaggaatcattcccagcatgttcgagccagagcgtgaaaaggtggatgccattgacggtgaatatcgcttgagaggagaagcacggaaaacttttgtggacctaatgagaagaggagacctaccagtctggttggcttataaagtggctgctgaaggtatcaactacgcagacagaagatggtgttttgacggaaccagaaacaatcaaatcttggaagaaaatgtggaagtggaaatctggacaaaggaaggggaaaggaaaaaattgaaacctagatggttagatgctaggatctactccgacccactggcgctaaaagaattcaaggaattcgcagccggaagaaagtccctaaccctgaacctaatcacagagatgggcagactcccaacttttatgactcagaaggccagagatgcactagacaacttggcggtgctgcacacggctgaagcgggtggaaaggcatacaatcatgctctcagtgaactaccggagaccctggagacattgcttttgctgacactgttggccacagtcacgggaggaatctttctattcctgatgagcggaaggggtatagggaagatgaccctgggaatgtgctgcataatcacggccagcatcctcttatggtatgcacaaatacaaccacattggatagcagcttcaataatattggagttctttctcatagtcttgctcattccagaaccagaaaagcagaggacaccccaggataaccaattgacttatgtcatcatagccatcctcacagtggtggccgcaaccatggcaaacgaaatgggttttctggaaaaaacaaagaaagacctcggactgggaaacattgcaactcagcaacctgagagcaacattctggacatagatctacgtcctgcatcagcatggacgttgtatgccgtggctacaacatttatcacaccaatgttgagacatagcattgaaaattcctcagtaaatgtgtccctaacagccatagctaaccaagccacagtgctaatgggtctcgggaaaggatggccattgtcaaagatggacattggagttcccctccttgctattgggtgttactcacaagtcaaccctataaccctcacagcggctcttcttttattggtagcacattatgccatcataggaccgggacttcaagccaaagcaaccagagaagctcagaaaagagcagcagcgggcatcatgaaaaacccaactgtggatggaataacagtgatagatctagatccaataccctatgatccaaagtttgaaaagcagttgggacaagtaatgctcctagtcctctgtgtgacccaagtgctgatgatgaggactacgtgggctttgtgtgaagccttaactctagcaaccggacccgtgtccacattgtgggaaggaaatccagggagattctggaacacaaccattgcagtgtcaatggcaaacatctttagagggagttacctggctggagctggacttctcttttctatcatgaagaacacaaccagcacgagaagaggaactggcaacataggagaaacgctaggagagaaatggaaaagcaggctgaacgcattggggaaaagtgaattccagatctacaaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagtttgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagtaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtggtag

SEQ ID NO: 6689 - RNA, 9876 nt, synthetic construct
  misc_feature 1..9876: note = derived and/or modified CDS sequence (wt) from DENV-2__KF955359__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggggttaacatgtgcaccctcatggccatagaccttggtgaattgtgtgaagatacaatcacgtacaagtgtcccctcctcaggcagaatgaaccagaagacatagattgttggtgcaactccacgtccacatgggtaacttatggaacatgtaccaccacaggagaacacagaagggaaaaaagatcagtggcactcgttccacatgtgggcatgggactggagacacgaactgaaacatggatgtcatcagaaggggcctggaaacacgttcagagaattgaaacctggatcttgagacatccaggctttaccacaatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggtcgacatagtcttagaacatggaagttgtgtgacgacgatggcaaaaaataaaccaacattggattttgaactgataaaaacagaagccaaacaacctgccattctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaagggggcattgtaacctgtgctatgttcacatgcaaaaagaacatggaaggaaaagttgtgctgccagaaaatctggaatacaccatcgtgataacacctcactcaggagaagagcacgctgtaggcaatgatacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaactggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgatcacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggccctccaccaagttttcggagcaatctatggggctgcttttagtggggtctcatggactatgaaaatcctcataggagttatcatcacatggataggaatgaattcacgtagcacctcactgtctgcgtcactagtattggtgggaatcgtgacactgtacttgggggttatggtgcaggctgacactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcactggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggctttgacgataaaaggtctcaatccaacagccatctttctaacaactctttcgagaaccagcaagaaaaggagttggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagaaagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattactggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgctttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagtaacattctggacatagatctacgtcctgcatcagcatggacgctgtatgccgtggccacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctggtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaactttagcaaaagaaggcatcaaaagaggggaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacactcaattttgcgtaaaggttctcaacccatacatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagctacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagccttgggggccatattcactgatgagaacaaatggaaatcggctcgtgaggctgttgaagatagtaggttttgggaactggttgacagggaaagaaatcttcatcttgaaggaaagtgtgaaacatgtgtgtacaacatgatggggaaaagagagaagaaactaggggagttcggcaaggcaaaaggtagcagagccatatggtatatgtggcttggagcacgtttcttagagtttgaagccctaggattcttgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtatcaaaacaaggtggtgcgtgtacaaagaccaacaccaagaggcacagtaatggacatcatatcgagaaaagaccaaagaggcagcgggcaagtcggcacctatggccttaatacttttaccaacatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcatgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcgaatgccatttgctcggcagtcccatcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6690 - RNA, 9876 nt, synthetic construct
  misc_feature 1..9876: note = derived and/or modified CDS sequence (wt) from DENV-2__KF955360__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtgccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtgtcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaaaaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaagcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggctggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagacatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagttccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagttccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6691 - RNA, 9876 nt, synthetic construct
  misc_feature 1..9876: note = derived and/or modified CDS sequence (wt) from DENV-2__KF955363__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatataccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcctctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggcaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcattacatggataggaatgaattcacgtagcacctcactgtctgtgtcactagtattggtgggagtcgtgacactgtacctgggagctatggtacaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaagtaacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattagaaagtgagatgataattccaaaaaattttgctgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacctatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcggaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaaaaaacaacgagctggagtattgtgggacgtcccttcacccccaccagtgggaaaagccgaactggaagatggagcctatagaatcaagcaaagagggattcttggatattcccagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaggaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacactgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaaaggcgtacaatcatgctctcagtgaactgccggaaaccctggagacactgcttttactgacacttctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctactcacaagtcaaccctataacactcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattgatgatgaggactacatgggctctgtgtgaggctctaaccttagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatacatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctagggagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaattcacaagaaaggtgagaagcaatgcagccttgggggccatattcactgatgagaacaaatggaaatcggcacgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggggcacgcttcttagagtttgaagccctaggattcttgaatgaagatcactggttctccagagggaactccctgagtggagtggaaggagaagggctgcacaggctaggctacattttaagagacgtgagcaagaaggaagggggggcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggtcatcagtggagatgattgtgttgtaaagcctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccgtgcagaaaccaagatgaactgattggtagagcccgaatttcccagggagccgggtggtctttgaaggagacggcctgcttggggaagtcttacgcccaaatgtggaccctgatgtacttccacagacgtgacctcagactggcggcaaatgccatttgctcggcagtcccgtcacattgggttccaacaagccgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacattcaaacagcaataaatcaagtcagatcccttataggcaatgaggaatacacagactacatgccatccatgaagagatttagaagggaagaggaagaggcaggtgtcctgtggtag

SEQ ID NO: 6692 - RNA, 9876 nt, synthetic construct
  misc_feature 1..9876: note = derived and/or modified CDS sequence (wt) from DENV-2__EU726767__SS-prME
  source 1..9876: mol_type = other RNA
tctgcaggcatgatcattatgctgattccaacagtgatggcgtttcatctaaccacacgtaacggagaaccacacatgatcgtcagtagacaagagaaagggaaaagtcttctgtttaaaacagaggatggcgtgaacatgtgcaccctcatggccatggaccttggtgaattgtgtgaagacacaatcacgtacaagtgtcccctcctcaggcagaatgagccagaagatatagactgttggtgcaactccacgtccacgtgggtaacctatgggacttgtgccaccacgggagaacatagaagagaaaaaagatcagtggcactcgttccacatgtgggaatgggactggagacgcgaactgaaacatggatgtcatcagaaggggcttggaaacatgcccagagaattgaaacatggatcctgagacatccaggcttcaccataatggcagcaatcctggcatacaccatagggacgacacatttccagagagccctgattttcatcctactgacagctgttgctccttcaatgacaatgcgttgcataggaatatcaaatagagactttgtagaaggggtttcaggaggaagctgggttgacatagtcctagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggacaagaggttcgtctgcaaacactccatggtagacagaggatgggggaatggatgtggattatttggaaagggaggcattgtgacctgtgctatgttcacatgcaaaaagaacatggaagggaaaatcgtgcaaccagaaaacttagaatacaccattgtggtaacaccccactcgggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggatcccaagaaggggccatgcatacagcactcacaggagccacagaaatccaaatgtcatcaggaaacttactcttcactggacatctcaagtgcaggctgagaatggacaagctacagctcaaaggaatgtcatactctatgtgcacaggaaagttcaaagttgtgaaggaaatagcagaaacacaacatggaacgatagttatcagagtgcaatatgaaggggacggctccccatgtaaaatcccttttgagataatggatttggaaaaaagatatgtcttaggccgcctaatcacagtcaacccaattgtgacagaaaaagatagcccagtcaacatagaagcagaacctccattcggagacagctacatcatcataggagtagagccgggacaactgaagctcaattggtttaagaaaggaagttctattggccaaatgtttgagacaacaatgaggggggcgaagagaatggccattttgggtgacacagcctgggatttcggatccctgggaggagtgtttacatctataggaaaagctctccaccaagtctttggagcaatctatggagcggccttcagtggggtttcatggactatgaaaatcctcataggagtcattatcacatggataggaatgaattcacgcagcacctcactgtccgtgtcactagtattggtgggaattgtgacactgtatttgggagtcatggtgcaggccgatagtggttgcgtcgtgagctggaaaaacaaagaactgaaatgtggcagtggaattttcatcacagacaacgtgcacacatggacagaacaatacaagttccaaccagaatccccttcaaaactggcttcagctatccagaaagctcaagaagagggaatttgtggaatccgctcagtaacaagattggagaatctaatgtggaaacaaataacaccagaattgaatcacattttagcagaaaatgaggtgaagttaactatcatgacaggagacgtcaaaggaatcatgcaggcaggaaaacgatctctgcggcctcagcccactgagctaaagtattcatggaaaacatggggcaaagcaaaaatgctctccacagagtcccataaccaaacctttctcattgatggccccgaaacagcagaatgccccaacacaaatagagcttggaactcgctggaggttgaagactacggctttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctatcatacacaaatagcaggaccatggcatctaggtaagcttgagatggactttgatttctgcgaaggaactacagtggtagtgactgaggactgcggaaatagaggaccctctttgagaacaaccactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactaggagtcttgggaatggcattgttcctggaggaaatgcttaggacccgagtaggaacgaaacatgcaatactactagttgcagtttcttttatgacattgatcacagggaacatgtccttcaaagacctaggaagagtggtggttatggtaggcgccgccatgacggatgacataggcatgggcgtgacttatcttgccctactagcagccttcaaagttagaccaacttttgcagctggactactcctgagaaagctgacctccaaggaattgatgatgactaccataggaattgcactcctctcccaaagcaccataccagagaccattcttgaattgactgatgcgttagccttaggcatgatggtcctcaaaatggtaagaaacatggaaaagtatcaattagcagtgaccatcatggctatcttgtgtgtcccaaacgcagtgatattacaaaatgcatggaaagtgagttgtacaatactggcagtggtgtccgtttccccactgcttttgacttcctcacagcaaaaaacggattggataccattagcattgacaatcaagggtctcaatccaacagccatttttctaacaaccctctcaagaaccagtaagaaaaggagctggccactgaatgaggctatcatggcagtcggaatggtgagcattttagccagttctctcctaaaaaatgatattcccatgacaggaccactagtggctggagggctcctcactgtgtgctacgtgctcactggacgatcggccgacttggaactggagagagcgaccgatgtcaaatgggaagaccaggcagagatatcaggaagcagtccaatcctgtcaataacaatatcagaagatggtagcatgtcgataaaaaatgaagaggaagaacagacactgaccatactcattagaacaggattgctggtgatctcaggactttttcctgtatcaataccgattacggcagcagcatggtacctgtgggaagtgaagaaacaacgggccggagtattgtgggatgttccttcacccccacccatgggaaaggctgaactggaagatggagcctacagaatcaagcaaaaagggattcttggatattcccagatcggagctggagtttacaaagaaggaacattccatacaatgtggcatgtcacacgtggcgctgtcctaatgcacaaaggaaagaggattgaaccgtcatgggcggacgtaaaaaaagatctaatatcatatggaggaggctggaagttagaaggagaatggaaggaaggagaagaagtccaggtgctggcattggagcctggaaaaaatccaagagccgtccaaacaaaacctggtcttttcaaaaccaacgccggaacaataggtgccgtatctctggacttttcccctggaacgtcgggatctccaatcattgacaaaaaaggaaaagttgtaggtctttatggtaatggtgttgttacaaggagtggagcatatgtgagtgctatagcccaaactgaaaaaagcattgaagacaacccagagatcgaagatgacatattccgaaagagaagactgaccatcatggacctccacccaggagcgggaaagacgaaaagataccttccggccatagtcagagaagctataaaacggggtttgagaacattaatcttggcccccaccagagtagtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggattttcatgacggccactcctccgggaagcagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaggctgagagggttatagaccccagacgttgcatgaaaccagtcatactaacagatggtgaggagcgggtgatcctggcaggacccatgccagtgacccactctagtgcagcacaaagaagagggagaatagggagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgagccagaacgtgaaaaagtggatgccattgatggcgaataccgcttgagaggagaagcaaggaaaacctttgtggacttgatgagaagaggagacctaccagtctggttggcctacaaagtggcagctgaaggcatcaactatgcagacagaaggtggtgttttgatggaatcaagaacaaccaaatcttggaagaaaatgtggaagttgaaatctggacaaaagaaggggaaaggaagaaattgaaacccagatggctggatgcaaggatttattctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctggagacactgcttttactgacacttctggctacagtcacgggagggatctttttattcttgatgagcgggaggggcatagggaagatgaccctgggaatgtgctgcataatcacggctagcatccttctatggtacgctcaaatacagccacactggatagcagcttcaataatactggagttttttcttatagttttgcttattccagaaccagaaaaacagagaacaccccaagacaatcaattgacctacgttgtcatagccatcctcacagtggtggccgcaaccatggcaaacgagatgggtttcctagaaaaaacgaagaaagatcttggactaggaagcattgtaacccagcaacccgagagcaacatcctggacatagatctacgccccgcatcagcgtggacgctgtatgccgtggccacaacatttgtcacaccaatgctgagacatagcattgagaattcctcagtgaatgtatccctaacagctatagccaaccaagcaacagtgttgatgggtctagggaaaggatggccgttgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcagctggcatcatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacaccaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaattcaggaagtggatagaaccttagcaaaagaaggcatcaaaagaggagaaacggaccatcacgctgtgtcacgaggctcagcaaaactgagatggttcgttgagagaaatatggtcacaccagaagggaaagtagtggacctcggttgtggcagaggaggttggtcatactattgtggaggactaaaaaacgtaagagaagtgaaaggcctaacaaaaggaggaccaggacatgaagaacccatccccatgtcaacatatgggtggaacctagtgcgtcttcaaagtggagttgacgttttcttcatcccgccagaaaagtgtgacacattgttgtgtgacataggggagtcatcaccaaaccccacagtggaagcaggacgaacactcagagtccttaatttagtagaaaattggttgaacaacaacactcaattttgcataaaggttctcaacccatatatgccctcagttatagaaaaaatggaagcactgcaaaggaaatatggaggagccttagtgagaaatccactctcacggaactccacacatgagatgtactgggtatccaacgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaacttagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccgtgggacgtccttcccacggtgacacagatggcaatgacagacacgactccatttggacaacagcgtgtctttaaagaaaaagtggacacgagaacccaagaaccgaaagaaggcacgaagaaactaatgaaaatcacggcagagtggctgtggaaagaattagggaagaaaaagacacctaggatgtgcaccagagaagaatttacaagaaaggtgagaagcaatgcagccttgggggccgtattcactgatgagaacaagtggaagtcggcacgtgaggctgttgaagatagtaggttttgggagctggttgacaaggaaaggagtctccatcttgaaggaaagtgtgaaacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtaccaaaacaaggtggtgcgtgtgcaaagaccaacaccaagaggcacagtaatggacattatatcgagaagagaccaaagaggtagtgggcaagttggcacctatggactcaatactttcaccaacatggaagcccaattaatcagacagatggagggagaaggagtctttaaaaacattcagcacttgacagtcacagaagaaatcgccgtgcaaaactggttagcaagggtggggcgcgaaaggttatcaagaatggccatcagtggagatgattgtgttgtgaaacctttagatgacaggtttgcaagcgctttgacagctctgaatgacatgggaaagattagaaaggacatacaacaatgggaaccttcaagaggatggaacgattggacacaagtccccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcggtgccatcacattgggttccaacaagtcgaacaacctggtccatacacgccaaacatgaatggatgacaacggaagacatgctgacagtctggaacagagtgtggattcaagaaaacccatggatggaagacaaaaccccagtggaatcatgggaggaaatcccatacttgggaaaaagagaagaccaatggtgcggctcactgattgggttaacaagcagggccacatgggcaaagaacatccaagcagcaataaatcaagttagatctctcataggcaatgaggaatacacagattatatgccatccatgaaaagattcagaagagaagaggaagaagcaggagtcctgtggtag

SEQ ID NO: 6693 - RNA, 9876 nt, synthetic construct
  misc_feature 1..9876: note = derived and/or modified CDS sequence (wt) from DENV-2__EU687246__SS-prME
  source 1..9876: mol_type = other RNA
tctgcaggcatgatcatcatgctgattccaacagtaatggcgttccatctaaccacacgcaacggagaaccacacatgatcgtcagtatacaagagaaagggaaaagtcttctgtttaagacagaggatggcgtgaacatgtgcacccttatggctatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcacttgttccacatgtgggaatgggactggagacgcgaaccgaaacatggatgtcatcagaaggggcttggaaacatgcccagagaatcgaaacttggatcctgagacatccaggcttcaccataatggcagcaatcctggcatacaccatagggacgacacatttccagagagccttgattttcatcctactgacagctgtcgctccttcaatgacaatgcgctgcataggaatatcaaatagagactttgtagaaggggtttcaggaggaagctgggttgacatagtcttagaacatggaagctgcgtgacgacgatggcaaaaaacaaaccaacattggattttgaactgataaaaacggaagccaaacagcctgccaccctaagaaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggacacacaagggtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttactcttcactggacatctcaagtgcaggctgagaatggacaagctacagctcaaaggaatgtcatactctatgtgcacaggaaagtttaaagttgtgaaggaaatagcagaaacacaacacggaacgatagttatcagagtgcaatatgaaggggacggctctccatgtaaaatcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggttcaagaaaggaagctctatcggccaaatgtttgagacaacaatgaggggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtattggtaggaattgtgacactgtatttgggagtcatggtgcaggccgatagtggttgcgttgtgagctggaaaaacaaagaactgaaatgtggcagtgggattttcatcacagacaacgtgcacacgtggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggccccagcccactgagctaaagtattcatggaaaacatggggcaaagcaaaaatgctctccacagagtctcataaccaaaccttccttattgatggccccgaaacagcagaatgccccaatacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggcaagcttgagatggactttgatttctgcgatggaaccacagtggtagtgactgaggactgcggaaatagaggaccctctttgagaacaactactgcctcaggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcattaggagtcttgggaatggcattgttcctggaggaaatgcttaggacccgagtaggaacgaaacatgcaatactactagttgcactttcttttgtgacattgatcacagggaacatgtcctttaaagacctaggaagagtggtggttatggtgggcgccaccatgacggatgacataggtatgggtgtaacttatcttgccctactagcagccttcaaagtcagaccaacttttgcagctggactactcttgagaaaactgacctccaaggaattgatgatgactaccataggaattgtactcctctcccaaagcaatataccagagaccattcttgaattgactgatgcgttagccttaggcatgatggtcctcaaaatagtaagagacatggaaaagtatcaattagcagtgactatcatggctatcttgtgcgtcccaaacgcagtgatattacaaaatgcatggaaagtgagttgcacaatactagcagtggtgtccgtttccccactgcttttgacatcctcacagcaaaaaacggattggataccattagcattgacaatcaaaggtctcaatccaacagccatttttctaacaaccctctcaagaaccaacaagaaaaggagctggccactaaatgaggctatcatggcagtcggaatggtgagcattttagctagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtaatctcaggactttttcctgtatcaataccaatcacggcagcagcatggtacctgtgggaagtgaagaaacaacgggccggagtattgtgggatgttccttcacccccacccatgggaaaggcggaactggaagatggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagctagaaggagaatggaaggaaggagaagaagtccaggtgctggcattggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccagactgaaaaaagcattgaagacaacccagacatcgaagatgacattttccgaaagagaagactgaccatcatggacctccacccaggagcgggaaagacgaaaagataccttccggccatagtcagagaagccataaaacggggtttgagaacattaatcttggcccccaccagagttgtggcagctgaaatggaggaagctctcagaggacttccaataagataccaaaccccagccatcagagctgaacacacagggcgggaaattgtggatctaatgtgtcatgccacatttaccatgaggctgctatcaccagttagagtgccaaactacaacctgattatcatggatgaagcccatttcacagacccagcaagtatagcagctagaggatacatctcaactcgggtggagatgggtgaagcagctgggattttcatgacagccactccaccgggaagcagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtgatacaacttagtaggaagacttttgattctgagtatatcaagactagaaccaatgattgggatttcgtggttacaactgacatttcagaaatgggtgccaatttcaaggctgagagggttatagaccccagacgctgcatgaaaccagtcatattaacagatggtgaggagcgggtgattctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacataaacacaccagaaggaatcattcccagtatgtttgaaccagagcgtgaaaaggtggatgccattgatggcgaataccgcttgagaggagaagcaaggaaaacctttgtggacctaatgagaagaggagacctaccagtctggttggcctacaaagtggcagctgaaggcatcaactatgcagacagaaggtggtgttttgatggaatcaagaacaaccaaatcctggaagagaatgtggaagttgaaatatggacaaaagaaggggaaaggaagaaattgaaacccagatggctggatgctaggatctactctgacccactggcgctaaaagaattcaaagaatttgcagccggaagaaagtctctgaccctgaacctaattacagaaatgggcaggcttccaacattcatgactcagaagacaagagacgcactggacaacttagcagtgctgcacacggctgaagcaggtggaagggcgtacaatcatgctctcagtgaactgccggagaccttggagacactgcttttactgacacttctggctacagtcacgggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctatgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgccccgcatcagcatggacgctgtatgccgtggctacaacatttattacaccaatgctgagacatagcattgagaattcctcagtgaatgtatccctaacagctatagccaaccaagcaacagtgttaatgggcctagggaaaggatggccattgtcaaagatggacatcggagttccccttctcgccattggatgctactcacaagtcaatcccataactctcacagcagctcttctcttattgatagcgcattatgccatcatagggccaggacttcaagcaaaagcaaccagagaagctcagaaaagagcagcggcgggcatcatgaaaaacccaaccgtcgacggaataacagtgattgatctagatccaataccttatgatccaaagttcgaaaagcagttgggacaagtaatgctcctagtcctctgcgtgactcaagtattgatgatgaggactacatgggctctgtgtgaggccttaaccttagctaccgggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacctatccccatgtcaacatatgggtggaatctagtgcgtcttcaaagtggagttgacgttttcttcatcccgcccgaaaagtgtgacacattgttgtgtgacataggggagtcatcaccaaatcctacagtggaagcaggacgaacactcagagtccttaatttagtagaaaactggttgaacaacaacactcaattttgcataaaagttctcaacccatatatgccctcagttatagaaaaaatggaaacactgcaaaggaaatatggaggagccttggtgagaaatccactctcacggaactccacacatgagatgtactgggtatccaatgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaatctagacataattgggaaaagaatagaaaaaataaagcaagagcatgaaacatcatggcactacgaccaagaccacccatacaaaacgtgggcataccatggcagctatgaaacaaaacagactggatcagcatcatccatggtcaacggagtggtcaggctgctgacaaaaccttgggacgtcctccccacggtgacacagatggcaatgacagacacgactccatttggacaacagcgtgttttcaaagaaaaagtggacacgagaacccaagaaccgaaagaaggcacgaagaaactaatgaagatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaactagccgaggctattttcaaactaacgtaccaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattgatcagacagatggagggagaaggagtttttaaaaacattcagcacctgacagtcacagaagaaatcgccgtgcaaaactggctagcaagagtggggcgcgaaaggttatcaagaatggccatcagtggagatgattgtgttgtgaaacctttagatgacaggttcgcaagcgctttgacagctctaaatgacatgggaaagattagaaaagacatacaacaatgggaaccttcaaggggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggttggcggcaaatgccatttgctcggcagtgccatcacattgggtgccaacaagtcgaacaacctggtccatacacgccaaacatgaatggatgacaacggaagacatgctgacagtctggaatagggtgtggattcaggaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcagtgaggaatacacagattacatgccatccatgaaaagattcagaagagaagaggaagaagcaggagtcctgtggtag

SEQ ID NO: 6694 - RNA, 9876 nt, synthetic construct
  misc_feature 1..9876: note = derived and/or modified CDS sequence (wt) from DENV-2__FJ639828__SS-prME
  source 1..9876: mol_type = other RNA
tctgtaggcatgatcattatgctgattccaacagtaatggcgttccatctaaccacacgcaacggagaaccacacatgatcgtcagtatacaagagaaaggaaaaagccttctgtttaaaacagaggatggcgtgaacatgtgcaccctcatggccatggaccttggtgaattgtgtgaagacacaatcacgtacaagtgtccccttctcaggcagaatgagccagaagacatagactgctggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagaaccctgattttcatcctactgacagctgtcgctccttcaatgacaatgcgttgcataggaatatcaaatagagactttgtagaaggggtctcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgctgcccaacacaaggggaacccagcctaaaagaagagcaggataagaggttcgtctgcaaacactccatggtagacagaggatggggaaatggatgtggattatttggaaaaggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattgccatggctgcccggagcggatacacaagggtcaaattggatacagaaagaaacattggtcactttcaaaaatccccatgcgaagaaacaggatgtcgttgttttaggatcccaagaaggggccatgcatacagcactcacaggagccacagaaatccaaatgtcgtcaggaaacttactcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtacaatatgaaggggacggctctccatgtaaaatcccttttgagataatggatttggaaaaaagatatgtcttaggccgcctgatcacagtcaacccaattgcgacagaaaaagatagcccagtcaacatagaagcagaacctccattcggagacagctacatcatcataggagtagagccgggacaactgaagctcaactggttcaagaaaggaagttctatcggccaaatgtttgagacaacaatgaggggggcgaagagaatggccattttgggtgacacagcctgggatttcggatccttgggaggagtgtttacatctataggaaaagccctccaccaagtctttggagcaatctatggagctgccttcagtggggtttcatggactatgaaaatcctcataggagtcattatcacatggataggaatgaactcacgcagcacctcactgtctgtgtcactagtattggtgggagttgtgacactgtatttgggagtcatggtgcaggccgatagtggttgcgtcgtgagctggaaaaacaaagaactgaaatgtggcagtgggattttcatcacagacaacgtgcacacatggacagaacaatacaagttccaaccagaatccccttcaaaactagcttcagccatccaaaaagctcaagaagagggaatttgtgggatccgctcagtaacaagattggagaacctaatgtggaaacaaataacaccagaattgaatcacattctagcagaaaatgaggtgaagttaactattatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccgagacagcagaatgccccaacacaaatagagcttggaactcgttggaagttgaagactacggttttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaggcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctccggaaaactcataacagaatggtgctgtcgatcttgcacattaccacccctaagatacagaggtgaggatgggtgctggtacgggatggaaatcagaccattgaaagagaaagaagaaaatttggttaactccttggtcacagccggacatgggcaggttgacaatttttcactaggagtcttgggaatggcactgttcctggaggaaatgcttaggacccgagtaggaacgaaacatgcgatactactagttgcagtttcttttgtgacattgatcacagggaacatgtcctttaaagatctaggaagagtggtggttatggtaggcgccaccatgacggatgacataggtatgggcgtaacttatcttgccctactagcagccttcaaagtcagaccaacttttgcagcaggactattcttgagaaagctgacctccaaggaattgatgatgactaccataggaattgtactcctctcccagagcactttaccagaaaccatccttgaattgactgatgcgttagccttaggcatgatggtcctcaaaatggtaagagacatggaaaagtatcaattagcagtgaccatcatggctatcttgtgcgtcccaaatgcagtgatattacaaaatgcatggaaagtgagttgcacaatactagcagtggtgtccgtttccccactgcttttgacatcctcacagcaaaaaacggattggataccattagcattgacaatcaagggtctcaatccaacagccatctttctgacaaccctctcaagaaccaacaagaaaaggagctggccactaaatgaggctatcatggcagtcggaatggtgagcattttagccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacagcagcagcatggtacctgtgggaagtgaagaaacaacgggccggagtattgtgggatgttccttcacccccacccatgggaaaggctgaactggaagatggagcctacagaatcaagcaaagagggattcttggatattcccagatcggagctggagtttataaagaaggaacattccatacgatgtggcatgtcacacgtggcgctgtcctaacgcataaaggaaagaggattgaaccatcatgggcggacgttaaaaaagatctaatatcatatggaggaggctggaagctagaaggagaatggaaggaaggagaagaagtccaggtgctggcattggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatacgtgagtgccatagcccaaactgaaaaaagcattgaagacaacccagacatcgaagacgacattttccgaaagagaagactgaccatcatggacctccacccaggagcgggaaagacgaaaagataccttccggccatagtcagagaagccataaaacggggtttgagaacattaatcttggcccccaccagagttgtggcagctgaaatggaggaagctctcagaggactcccaataagataccaaaccccagccatcagagctgagcacacagggcgggaaattgtggatctaatgtgtcatgccacatttaccatgaggctgctatcaccagttagagtgccaaactacaacctgattatcatggatgaagcccatttcacagacccagcaagtatagcagctagaggatacatctcaactcgagtggagatgggtgaagcagctgggattttcatgacagccactcccccgggaagcagagatccatttcctcagagcaatgcaccaatcatagatgaagaaagagaaatccctgaacgttcatggaattctggacatgagtgggtcacggattttaaaggaaaaactgtttggtttgttccaagcataaaagcaggaaatgatatagcagcctgcctgagaaagaatggaaagaaagtaatacaacttagcaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgatcagtacatatacatgggggaacctctggaaaatgatgaagactgtgcacactggaaagaagccaaaatgctcctagataacattaacacaccagaaggaatcattcccagtatgtttgaaccagagcgtgaaaaagtggacgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaatcaagaacaaccaaatcctggaagagaatgtggaagttgaaatctggacaaaagaaggggaaaggaagaaattgaaaccccgatggttggatgctaggatctactctgacccactggcgctaaaagaattcaaagaatttgcagccggaagaaagtctctgaccctgaacctaattacagaaatgggtaggcttccaacgttcatgacccagaagacaagagacgcactggataacttagcagtgctgcacacggccgaagcaggtggaagggcgtacaatcatgctctcagtgaactgccggagaccctggagacactgcttttactgacacttctggccacagtcacgggagggatctttttattcttgatgagcgggaggggcatagggaagatgaccctaggaatgtgctgcatagtcacggctagcatccttctatggtacgcacaaatacagccacactggatagcagcttcaataatactggagttttttctcatagttttgctcattccagaaccagaaaaacagagaacaccccaagacaaccaattgacctatgttgtcatagccatcctcacagtggtggccgcaaccatggcaaacgagatgggtttcctagaaaagacgaagaaagatcttggattaggaagcattgcaacccagcagcccgagagcaacatcctggacatagatctacgccccgcatcagcatggacgctgtatgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagctccccttctcgccattggatgctactcacaagtcaatcccataactctcacagcagctcttctcttattggtagcgcattatgccattatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcccatctccacactgtgggaaggaaatccaggaaggttctggaatactaccattgcggtgtcaatggctaacatctttagagggagttacttggctggagctggacttctcttttccattatgaagaacacaaccaactcaagaaggggaactggcaacataggagagacgcttggagagaaatggaaaagccgattgaacgcactgggaaaaagtgaattccagatctacaagaaaagtggaatccaggaggtggatagaaccttagcaaaagaaggcattaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctgacaaaaggaggaccaggacacgaagaacccatccctatgtcaacatatgggtggaatctagtgcgccttcaaagtggagttgacgttttcttcatcccgccagaaaagtgtgacacattgttgtgtgacataggggagtcatcaccaaatcctacagtggaagcaggacgaacactcagagtccttaatttggtagaaaattggttgaacaacaacactcaattttgcataaaagttcttaacccatacatgccctcagttatagaaaaaatggaaacactgcaaaggaaatatggaggagccttagtgagaaatccactctcacggaactccacacatgagatgtactgggtttccaatgcttccgggaacatagtgtcatcagtgaacatgatttcaaggatgttgatcaatagattcacaatgagacacaagaaagccacttacgagccggatgttgacctcggaagcggaacccgtaacattggaattgaaagtgagataccaaatctagacataattgggaaaagaatagaaaaaataaagcaagagcatgaaacatcatggcactacgaccaagaccacccatataaaacatgggcataccatggcagctatgaaacaaaacagactggatcagcatcatccatggtcaatggagtggtcaggctgttgacaaaaccttgggacgtcctccccaccgtgacacagatggcaatgacagacacgactccatttggacaacagcgtgtttttaaagaaaaagtggacacgagaactcaagaaccgaaagaaggcacgaagaaactaatgaaaatcacagcagagtggctgtggaaggaattagggaagaaaaagacacctaggatgtgcaccagagaagaatttacaagaaaggtgagaagcaatgcagccttgggggccatattcactgatgagaacaagtggaagtcggcacgtgaggctgttgaagatagcaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaggctaggttacattctgagagacgtgagcaagaaagagggaggagccatgtatgccgatgacacagcaggatgggacacaagaattacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtgggcaagttggtacctatggactcaacactttcaccaatatggaagcccaattaatcagacagatggagggagaaggagtttttaaaaacattcagcacctgacagtcacagaagaaatcgccgtgcagaactggttagcaagagtggggcgcgaaaggttatcaagaatggccatcagtggagatgattgtgttgtgaaacctttagatgacaggttcgcgagcgctttgacagctctaaatgacatgggaaagattagaaaagacatacaacaatgggaaccttcaagaggatggaacgattggacacaagtgcccttctgttcacaccatttccatgaactaatcatgaaggatggtcgtgtacttgttgttccatgcagaaaccaagatgaactgattggcagagcccgaatctcccaaggagcagggtggtccttgcgggagacggcctgtttggggaagtcttacgcccaaatgtggagcttgatgtatttccacagacgcgacctcaggttagcggcaaatgccatttgctcggcagtgccatcacattgggttccaacaagtcgaacaacctggtccatacacgccaaacatgaatggatgacaacggaagacatgctgacagtctggaatagggtgtggattcaagaaaacccatggatggaagacaaaaccccagtagaatcatgggaggaaatcccgtacttggggaaaagagaagatcaatggtgcggctcattgattgggttaacaagcagggccacatgggcaaagaacatccaagcagcaataaatcaagttagatctcttataggcaatgaggaatacacagactacatgccatccatgaaaagattcagaagagaagaggaagaagcaggagtcctgtggtag

SEQ ID NO: 6695 - RNA, 9876 nt, synthetic construct
  misc_feature 1..9876: note = derived and/or modified CDS sequence (wt) from DENV-2__FJ639829__SS-prME
  source 1..9876: mol_type = other RNA
tctgtaggcatgatcattatgctgattccaacagtaatggcgttccatctaaccacacgcaacggagaaccacacatgatcgtcagtatacaagagaaaggaaaaagccttctgtttaaaacagaggatggcgtgaacatgtgcaccctcatggccatggaccttggtgaattgtgtgaagacacaatcacgtacaagtgtccccttctcaggcagaatgagccagaagacatagactgctggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagaaccctgattttcatcctactgacagctgtcgctccttcaatgacaatgcgttgcataggaatatcaaatagagactttgtagaaggggtctcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgctgcccaacacaaggggaacccagcctaaaagaagagcaggataagaggttcgtctgcaaacactccatggtagacagaggatggggaaatggatgtggattatttggaaaaggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgtcgttgttttaggatcccaagaaggggccatgcatacagcactcacaggagccacagaaatccaaatgtcgtcaggaaacttactcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtacaatatgaaggggacggctctccatgtaaaatcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggttcaagaaaggaagttctatcggccaaatgtttgagacaacaatgaggggggcgaagagaatggccattttgggtgacacagcctgggatttcggatccttgggaggagtgtttacatctataggaaaagccctccaccaagtctttggagcaatctatggagctgccttcagtggggtttcatggactatgaaaatcctcataggagtcattatcacatggataggaatgaactcacgcagcacctcactgtctgtgtcactagtattggtgggagttgtgacactgtatttgggagtcatggtgcaggccgatagtggttgcgtcgtgagctggaaaaacaaagaactgaaatgtggcagtgggattttcatcacagacaacgtgcacacatggacagaacaatacaagttccaaccagaatccccttcaaaactagcttcagccatccaaaaagctcaagaagagggaatttgtgggatccgctcagtaacaagattggagaacctaatgtggaaacaaataacaccagaattgaatcacattctagcagaaaatgaggtgaagttaactattatgacaggagacatcaaaggaatcatgcaggcaggaaaacgatctctgcggcctcagcccactgagctaaagtattcatggaaaacatggggcaaagcaaaaatgctctccacagagtctcataatcaaacctttctcattgatggccccgagacagcagaatgccccaacacaaatagagcttggaactcgttggaagttgaagactacggttttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaggcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactaggagtcttgggaatggcactgttcctggaggaaatgcttaggacccgagtaggaacgaaacatgcgatactactagttgcagtttcttttgtgacattgatcacagggaacatgtcctttaaagatctaggaagagtggtggttatggtaggcgccaccatgacggatgacataggtatgggcgtaacttatcttgccctactagcagccttcaaagtcagaccaacttttgcagcaggactattcttgagaaagctgacctccaaggaattgatgatgactaccataggaattgtactcctctcccagagcactataccagaaaccatccttgaattgactgatgcgttagccttaggcatgatggtcctcaaaatggtaagagacatggaaaagtatcaattagcagtgaccatcatggctatcttgtgcgtcccaaatgcagtgatattacaaaatgcatggaaagtgagttgcacaatactagcagtggtgtccgtttccccactgcttttgacatcctcacagcaaaaaacggattggataccattagcattgacaatcaagggtctcaatccaacagccatctttctgacaaccctctcaagaaccaacaagaaaaggagctggccactaaatgaggctatcatggcagtcggaatggtgagcattttagccagttctctcctaaaaaatgatattcccatgacaggaccactagtggctggagggctcctcactgtgtgctacgtgctcactggacgatcggccgacttggaattggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacagcagcagcatggtacctgtgggaagtgaagaaacaacgggccggagtattgtgggatgttccttcacccccacccatgggaaaggctgaactggaagatggagcctacagaatcaagcaaagagggattcttggatattcccagatcggagctggagtttataaagaaggaacattccatacgatgtggcatgtcacacgtggcgctgtcctaacgcataaaggaaagaggattgaaccatcatgggcggacgttaaaaaagatctaatatcatatggaggaggctggaagctagaaggagaatggaaggaaggagaagaagtccaggtgctggcattggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatacgtgagtgccatagcccaaactgaaaaaagcattgaagacaacccagacatcgaagacgacattttccgaaagagaagactgaccatcatggacctccacccaggagcgggaaagacgaaaagataccttccggccatagtcagagaagctataaaacggggtttgagaacattaatcttggcccccaccagagttgtggcagctgaaatggaggaagctctcagaggactcccaataagataccaaaccccagccatcagagctgagcacacagggcgggaaattgtggatctaatgtgtcatgccacatttaccatgaggctgctatcaccagttagagtgccaaactacaacctgattatcatggatgaagcccatttcacagacccagcaagtatagcagctagaggatacatctcaactcgagtggagatgggtgaagcagctgggattttcatgacagccactcccccgggaagcagagatccatttcctcagagcaatgcaccaatcatagatgaagaaagagaaatccctgaacgttcatggaattctggacatgagtgggtcacggattttaaagggaaaactgtttggtttgttccaagcataaaagcaggaaatgatatagcagcctgcctgagaaagaatggaaagaaagtaatacaacttagcaggaagacttttgattctgagtatgtcaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacctatgccagtgactcactctagtgcagcacaaagaagagggagaataggaagaaatccaaaaaatgaaaatgatcagtacatatacatgggggaacctctggaaaatgatgaagactgtgcacactggaaagaagccaaaatgctcctagataacattaacacaccagaaggaatcattcccagtatgtttgaaccagagcgtgaaaaagtggacgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaatcaagaacaaccaaatcctggaagagaatgtggaagttgaaatctggacaaaagaaggggaaaggaagaaattgaaaccccgatggttggatgctaggatctactctgacccactggcgctaaaagaattcaaagaatttgcagccggaagaaagtctctgaccctgaacctaattacagaaatgggtaggcttccaacgttcatgacccagaagacaagagacgcactggataacttagcagtgctgcacacggccgaagcaggtggaagggcgtacaatcatgctctcagtgaactgccggagaccctggagacactgcttttactgacacttctggccacagtcacgggagggatctttttattcttgatgagcgggaggggcatagggaagatgaccctaggaatgtgctgcatagtcacggctagcatccttctatggtacgcacaaatacagccacactggatagcagcttcaataatactggagttttttctcatagttttgctcattccagaaccagaaaaacagagaacaccccaagacaaccaattgacctatgttgtcatagccatcctcacagtggtggccgcaaccatggcaaacgagatgggtttcctagaaaagacgaagaaagatcttggattaggaagcattgcaacccagcagcccgagagcaacatcctggacatagatctacgccccgcatcagcatggacgctgtatgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagctccccttctcgccattggatgctactcacaagtcaatcccataactctcacagcagctcttctcttattggtagcgcattatgccattatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcccatctccacactgtgggaaggaaatccaggaaggttctggaacactaccattgcggtgtcaatggctaacatctttagagggagttacttggctggagctggacttctcttttccattatgaagaacacaaccaactcaagaaggggaactggcaacataggagagacgcttggagagaaatggaaaagccgattgaacgcactgggaaaaagtgaattccagatctacaagaaaagtggaatccaggaggtggatagaaccttagcaaaagaaggcattaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgccttcaaagtggagttgacgttttcttcatcccgccagaaaagtgtgacacattgttgtgtgacataggggagtcatcaccaaatcctacagtggaagcaggacgaacactcagagtccttaatttggtagaaaattggttgaacaacaacactcaattttgcataaaagttcttaacccatacatgccctcagttatagaaaaaatggaaacactgcaaaggaaatatggaggagccttagtgagaaatccactctcacggaactccacacatgagatgtactgggtttccaatgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaatctagacataattgggaaaagaatagaaaaaataaagcaagagcatgaaacatcatggcactacgaccaagaccacccatataaaacatgggcataccatggcagctatgaaacaaaacagactggatcagcatcatccatggtcaatggagtggtcaggctgttgacaaaaccttgggacgtcctccccaccgtgacacagatggcaatgacagacacgactccatttggacaacagcgtgtttttaaagaaaaagtggacacgagaactcaagaaccgaaagaaggcacgaagaaactaatgaaaatcacagcagagtggctgtggaaggaattagggaagaaaaagacacctaggatgtgcaccagagaagaatttacaagaaaggtgagaagcaatgcagccttgggggccatattcactgatgagaataagtggaagtcggcacgtgaggctgttgaagatagcaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaggctaggttacattctgagagacgtgagcaagaaagagggaggagccatgtatgccgatgacacagcaggatgggacacaagaattacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtgggcaagttggtacctatggactcaacactttcaccaatatggaagcccaattaatcagacagatggagggagaaggagtttttaaaaacattcagcacctgacagtcacagaagaaatcgccgtgcagaactggttagcaagagtggggcgcgaaaggttatcaagaatggccatcagtggagatgattgtgttgtgaaacctttagatgacaggttcgcgagcgctttgacagctctaaatgacatgggaaagattagaaaagacatacaacaatgggaaccttcaagaggatggaacgattggacacaagtgcccttctgttcacaccatttccatgaactaatcatgaaggatggtcgtgtacttgttgttccatgcagaaaccaagatgaactgattggcagagcccgaatctcccaaggagcagggtggtccttgcgggagacggcctgtttggggaagtcttacgcccaaatgtggagcttgatgtatttccacagacgcgacctcaggttagcggcaaatgccatttgctcggcagtgccatcacattgggttccaacaagtcgaacaacctggtccatacacgccaaacatgaatggatgacaacggaagacatgctgacagtctggaatagggtgtggattcaagaaaacccatggatggaagacaaaaccccagtagaatcatgggaggaaatcccgtacttggggaaaagagaagatcaatggtgcggctcattgattgggttaacaagcagggccacatgggcaaagaacatccaagtagcaataaatcaagttagatctcttataggcaatgaggaatacacagactacatgccatccatgaaaagattcagaagagaagaggaagaagcaggagtcctgtggtag

SEQ ID NO: 6696 - RNA, 9876 nt, synthetic construct
  misc_feature 1..9876: note = derived and/or modified CDS sequence (wt) from DENV-2__FJ639831__SS-prME
  source 1..9876: mol_type = other RNA
tctgcaggcatgatcattatgctgattccaacagtaatggcgttccatctaaccacacgcaacggagaaccacacatgatcgtcagcatacaagagaaagggaaaagtcttctgtttaagactgaggatggcgtgaacatgtgcaccctcatggccatggaccttggtgaattgtgtgaagacacaatcacgtacaagtgtccccttctaaggcagaatgagccagaagacatagactgttggtgcaactccacatccacgtgggtaacctatgggacttgtaccaccacgggagaacatagaagagaaaaaagatcagtggcacttgttccacatgtgggaatgggactggagacgcgaaccgaaacatggatgtcatcagaaggggcttggaaacatgcccagagaatcgaaacttggatcctgagacatccaggcttcaccataatggcagcaatcctggcatacaccatagggacgacacatttccagagagccttgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgtccaacacaaggggaacccagcctaaaagaagagcaggataagaggttcgtctgcaaacactccatagtagacagagggtggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccgtcacagaagcagaattgacaggttatggcaccgtcacgatggagtgctctccgagaacaggcctcgatttcaatgagatggtgttgctgcagatggaaaataaagcttggctggtgcataggcaatggttcctagacctgccattaccatggctgcccggagcggacacacaagggtcaaattggatacagaaagaaacattggtcactttcaaaaatccccatgcgaagaaacaggatgttgttgttttaggatcccaagaaggggccatgcatacagcactcacaggggccacagaaatccaaatgtcgtcaggaaacttactcttcaccggacatctcaagtgcaggctgagaatggacaagctacagctcaaaggaatgtcatactccatgtgcacaggaaagttcaaagttgtgaaggaaatagcagaaacacaacatggaacgatagttatcagagtgcaatatgaaggggacggctctccatgtaaaatcccttttgagataatggacttggaaaagagatatgtcttaggccgcctgatcacagtcaacccaattgtgacagaaaaagatagcccagtcaacatagaagcagaacctccattcggagacagctacatcatcataggagtagagccaggacaactgaagctcaactggttcaagaaaggaagttctatcggccaaatgtttgagacaacaatgaggggggcgaagagaatggccattttgggtgacacagcctgggacttcggatccctgggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtactggtaggaattgtgacactgtacttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtaaaattaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttcttattgatggccccgaaacagcagaatgccccaacacaaatagagcttggaactcgttggaggttgaagactacggttttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaagcttctttcattgaagtaaaaaactgccactggccaaagtcacacaccctctggagtaatggagtgctagaaagcgagatgataattccaaagaatctcgctggaccagtgtctcaacacaactatagaccaggctaccatacacaaatagcaggaccatggcatctaggtaagcttgagatggactttgacttctgcgatggaaccacagtggtagtgactgaggactgcggaaatagaggaccctctttaagaacaactactgcttctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcagattgacaatttttcactaggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtgggcgccaccatgacggatgacataggcatgggcgtaacttatcttgccctactagcagccttcaaagtcagaccaacttttgtagctggactactcttgagaaaactgacctccaaggaattgatgatgactaccataggaattgtactcctctcccaaagcactataccagagactattcttgaattgactgatgcgctagccttaggcatgatggtcctcaaaatagtaagagacatggagaagtatcaattagcagtgactatcatggctatcttgtgcgtcccaaacgcagtgatattacaaaatgcatggaaagtgagttgcacaatactagcagtggtatccgtttccccactgcttttgacatcctcacagcaaaaaacggattggataccattagcattgacaatcaagggtctcaatccaacagccatttttctaacaactctctcaagaaccaacaagaaaaggagctggccactaaatgaggctatcatggcagtcggaatggtgagcattttagccagttctctcctaaaaaatgacattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctatgggaagtaaagaaacaacgggccggagtattgtgggatgttccttcacccccacccatgggaaaggctgaactggaagatggagcctacagaatcaagcaaaaaggggttcttgggtattcccagatcggagctggagtttataaagaaggaacattccatacaatgtggcatgtcacacgtggcgctgtcctaatgcacaaaggaaagaggattgaaccatcatgggcggacgtcaaaaaagatctaatatcatatggaggaggctggaagctggaaggagaatggaaggaaggagaagaagtccaggtgctggccttggagcctggaaaaaatccaagagctgtccaaacaaaacctggtcttttcaagaccaacactggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattgaagacaacccagacatcgaagatgacattttccgaaagagaagactgaccattatggacctccatccaggagcgggaaagacgaaaagatacctcccggccatagtcagagaagctataaaacggggtttgagaacattaatcttggcccccaccagagtcgtggcagctgaaatggaggaagctctcagaggacttccaataagataccaaaccccagccatcagagctgagcatacagggcgggaaattgtggatctaatgtgtcatgccacatttaccatgaggctgctatcaccagttagagtgccaaactacaacttgattatcatggatgaagcccatttcacagacccagcaagtatagcagctagaggatacatctcaactcgagtggagatgggtgaagcagctgggatttttatgacagccactcctccgggaagcagagatccatttcctcagagcaatgcaccaatcatagatgaagaaagagaaatccctgaacgttcatggaattctggacatgagtgggtcacggattttaaagggaagactgtctggttcgttccaagcataaaagcagggaatgatatagcagcttgcctgagaaaaaatggaaagaaagtgatacaacttagtaggaagacttttgactctgagtatgtcaagactagaaccaatgattgggatttcgtggttacaactgacatttcagaaatgggtgccaatttcaaggctgagagggttatagaccccagacgctgcatgaaaccagtcatactaacagatggtgaggagcgggtgatcctggcaggacctatgccagtgacccactctagtgcagcgcaaagaagagggaggataggaagaaatccaaaaaatgaaaatgaccagtacatatacatgggggaacctctggaaaatgatgaagactgtgcacactggaaagaagccaaaatgctcctagataacattaacacaccagaaggaatcattcccagtatgtttgaaccagagcgtgaaaaggtggatgccattgatggcgaatatcgcctgagaggagaagcaaggaaaacctttgtggacctaatgagaagaggagacctaccagtttggttggcctacaaagtggcagctgaaggcatcaactatgcagacagaaggtggtgttttgatggaatcaagaacaaccaaatcctggaagagaatgtagaagttgaaatctggacaaaagaaggggaaaggaaaaaattgaaacccagatggctggatgctaggatctactctgacccactggcgctaaaagaattcaaagaatttgcagccggaagaaagtctctgaccctgaacctaattacagaaatgggtaggcttccaacattcatgactcagaagactagagacgcactggacaacttagcagtgctgcacacggctgaggcaggtggaagggcgtacaatcatgctctcagtgaactgccggagaccctggagacactgcttttactgacacttctggctacagtcacgggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgctcattccagaaccagaaaaacagagaacaccccaagacaaccaattgacctatgttgtcatagccatcctcacagtggtggccgcaaccatggcaaacgagatgggtttcctagaaaaaacgaagaaagatcttggattaggaagcatcacaacccagcaacccgagagcaacatcctggacatagatctacgccccgcatcagcatggacgctgtatgccgtggctacaacatttgttacaccaatgctgagacatagcattgagaattcctcagtgaatgtatccctaacagccatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccattatagggccaggacttcaagcaaaagcaaccagagaagctcagaaaagagcagcggcgggcatcatgaaaaacccaaccgtcgatggaataacagtgattgatctagatccaataccttatgatccaaagtttgaaaagcagttgggacaagtaatgctcctagtcctctgcgtgactcaagtattgatgatgaggaccacatgggctatgtgtgaggccttaaccttagctaccgggcccatctccacattgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagaaacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctgacaaaaggaggaccaggacacgaagaacccatccccatgtcaacatatgggtggaatctagtgcgtcttcaaagtggagttgacgttttcttcatcccgcccgaaaagtgtgacacattgctgtgtgacataggggagtcatcaccaaatcctacagtggaagcaggacgaacactcagagtccttaatttagtagaaaattggttgaacaacaacactcaattttgtataaaagtcctcaacccatatatgccctcagttatagaaaaaatggaaacactgcaaaggaaatatggaggagccttagtgagaaatccactctcacggaactccacacatgagatgtactgggtatccaacgcttccgggaacatagtgtcatcagtgaacatgatttcaaggatgttgatcaacagatttacaatgagacacaagaaaaccacttacgagccggatgttgacctcggaagcggaacccgtaacattggaattgaaagtgagataccaaatctagacataattgggaaaagaatagaaaaaataaagcaagagcatgaaacatcatggcactacgaccaagaccacccatacaaaacgtgggcataccatggcagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaagctccatcttgaaggaaagtgtgaaacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagaaaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtgggcaagttggtacctatggactcaatactttcaccaatatggaagcccagttgatcagacagatggagggagaaggagtttttaaaaatattcagcacctgacagtcacagaagaaatcgccgtgcaaaactggttagcaagagtggggcgcgaaaggttatcaagaatggccatcagtggagatgattgtgttgtgaaacctttagatgacaggttcgcaagcgctttgacagctctaaatgacatgggaaagattagaaaagacatacaacaatgggaaccttcaagaggatggaacgattggacacaagtgcccttctgctcacaccatttccatgagctaatcatgaaggatggtcgtgtacttgttgttccatgcagaaaccaagatgaactgattggcagagcccgaatctcccaaggagcagggtggtctttgcgggagacggcttgtttggggaagtcttacgcccaaatgtggagcttgatatatttccacagacgcgacctcaggttggcggcaaatgccatttgctcggcagtgccatcacattgggttccaacaagccgaacaacctggtccatacacgccaaacatgaatggatgacaacggaagacatgctgacagtctggaatagggtgtggattcaggaaaacccatggatggaagacaaaaccccagtggaatcatgggaggaaatcccatacttggggaaaagagaagatcaatggtgtggctcactgattgggttaacaagcagggccacatgggcaaagaacattcaaacagcaataaatcaagttagatctcttataggcaatgaggaatacacagattacatgccatccatgaaaagattcagaagagaagaggaagaagcaggagtcctgtggtag

SEQ ID NO: 6697 - RNA, 9876 nt, synthetic construct
  misc_feature 1..9876: note = derived and/or modified CDS sequence (wt) from DENV-2__FJ639832__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgtttaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggacaagaggttcgtctgcaaacactccatggtagacagaggatggggaaatggatgtggattatttggaaaggggggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatctctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactacagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctaccatggcggatgacataggtatgggcgtgacttatcttgccctactagcagctttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaactctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggcctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgctgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgtaacattggaattgaaagtgaagtaccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacctgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6698 - RNA, 9876 nt, synthetic construct
  misc_feature 1..9876: note = derived and/or modified CDS sequence (wt) from DENV-2__FJ687434__SS-prME
  source 1..9876: mol_type = other RNA
tctgtaggcatgatcattatgttgattccaacagtaatggcgttccatctaaccacacgcaacggagaaccacacatgatcgtcagtatacaagagaaaggaaaaagccttctgtttaaaacagaggatggcgtgaacatgtgcaccctcatggccatggaccttggtgaattgtgtgaagacacaatcacgtacaagtgtccccttctcaggcagaatgagccagaagacatagactgctggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagaaccctgattttcatcctactgacagctgtcgctccttcaatgacaatgcgttgcataggaatatcaaatagagactttgtagaaggggtctcaggaggaagctgggttgacatagtcttagaacatggaagctgtgtgacgacaatggcaaaaaacaaaccaacattggattttgaactgataaaaacggaagccaaacagcctgccaccctaaggaagtactgcatagaagcaaggctaaccaacacaacaacagaatctcgctgcccaacacaaggggaacccagcctaaaagaagagcaggataagaggttcgtctgcaaacactccatggtagacagaggatggggaaatggatgtggattatttggaaaaggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaagcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgtcgttgttttaggatcccaagaaggggccatgcatacagcactcacaggagccacagaaatccaaatgtcgtcaggaaacttactcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtacaatatgaaggggacggctctccatgtaaaatcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggttcaagaaaggaagttctatcggccaaatgtttgagacaacaatgaggggggcgaagagaatggccattttgggtgacacagcctgggatttcggatccttgggaggagtgttcacatctataggaaaagccctccaccaagtctttggagcaatctatggagctgccttcagtggggtttcatggactatgaaaatcctcataggagtcattatcacatggataggaatgaactcacgcagcacctcactgtctgtgtcactagtattggtgggagttgtgacactgtatttgggagtcatggtgcaggccgatagtggttgtgtcgtgagctggaaaaacaaagaactgaaatgtggcagtgggattttcatcacagacaacgtgcacacatggacagaacaatacaagttccaaccagaatccccttcaaaactagcttcagctatccaaaaagctcaagaagagggaatttgtgggatccgctcagtaacaagattggagaacctaatgtggaaacaaataacaccagaattgaaccacattctagcagaaaatgaggtgaagttaactattatgacaggagacatcaaaggaatcatgcaggcaggaaaacgatctctgcggcctcagcccactgagctaaagtattcatggaaaacatggggcaaagcaaaaatgctctccacagagtctcataatcaaacctttctcattgatggccccgaaacagcagaatgccccaacacaaatagagcttggaactcgttggaagttgaagactacggttttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggacctgtgtctcaacacaactatagaccaggctaccatacacaaatagcaggaccatggcatctaggtaagcttgagatggactttgatttctgcgatggaaccacagtggtagtgactgaggactgcggaaatagaggaccctccttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactaggagtcttgggaatggcactgttcctggaggaaatgcttaggacccgagtaggaacgaaacatgcgatactactagttgcagtttcttttgtgacattgatcacagggaacatgtcctttaaagatctaggaagagtggtggttatggtaggcgccaccatgacggatgacataggtatgggcgtaacttatcttgccctactagcagccttcaaagtcagaccaacttttgcagcaggactactcttgagaaagctgacctccaaggaattgatgatgactaccataggaattgtactcctctcccagagcactataccagaaaccatccttgaattgactgatgcgttagccttaggcatgatggtcctcaaaatggtaagagacatggaaaagtatcaattagcagtgactatcatggctatcttgtgcgtcccaaatgcagtgatattacaaaatgcatggaaagtgagttgcacaatactagcagtggtgtccgtttccccactgcttttgacatcctcacagcaaaaaacggattggataccattagcattgacaatcaagggtctcaatccaacagccatctttctgacaaccctctcaagaaccaacaagaaaaggagctggccactaaatgaggctatcatggcagtcggaatggtgagcattttagccagttctctcctaaaaaatgatattcccatgacaggaccactagtggctggagggctcctcactgtgtgctacgtgctcactggacgatcggccgacttggaactggagagagcaaccgatgtcaaatgggaagaccaggcggagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacagcagcagcatggtacctgtgggaagtgaagaaacaacgggccggagtattgtgggatgttccttcacccccacccatgggaaaggctgaactggaagatggagcctacagaatcaagcaaagagggattcttggatattcccagatcggagctggagtttataaagaaggaacattccatacgatgtggcatgtcacacgtggcgctgtcctaatgcataaaggaaagaggattgaaccatcatgggcggacgttaaaaaagatctaatatcatatggaggaggctggaagctagaaggagaatggaaggaaggagaagaagtccaggtgctggcattggagcctggaaaaaatccaagagccgtccaaacaaaacctggtcttttcaaaaccaacaccggaacaataggtgccgtatccctggacttttcccctggaacgtcaggatctccaatcattgacaaaaaaggaaaagttgtgggtctttatggtaatggtgttgttacaaggagtggagcatacgtgagtgccatagcccaaactgaaaaaagcattgaagacaacccagacatcgaagacgacattttccgaaagagaagactgaccatcatggacctccacccaggagcgggaaagacgaaaagataccttccggccatagtcagagaagctataaaacggggtttgagaacattaatcttggcccccaccagagttgtggcagctgaaatggaggaagctctcagaggactcccaataagataccaaaccccagccatcagagctgagcacacagggcgggaaattgtggatttaatgtgtcatgccacatttaccatgaggttgctatcaccagttagagtgccaaactacaacctgattatcatggatgaagcccatttcacagacccagcaagtatagcagctagaggatatatctcaactcgagtggagatgggtgaagcagctgggattttcatgacagccactcccccgggaagcagagatccatttcctcagagcaatgcaccaatcatagatgaagaaagagaaatccctgaacgttcatggaattctggacatgagtgggtcacggattttaaagggaaaactgtttggtttgttccaagcataaaagcaggaaatgacatagcagcttgcctgagaaagaatggaaagaaagtaatacaacttagcaggaagacttttgattctgagtatgtcaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacctatgccagtgactcactctagtgcagcacaaagaagagggagaataggaagaaatccaaaaaatgaaaatgaccagtacatatacatgggggaacctctggaaaatgatgaagactgtgcacactggaaagaagccaaaatgctcctagataacattaacacaccagaaggaatcattcccagtatgtttgaaccagagcgtgaaaaagtggacgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaatcaagaacaaccaaatcctggaagagaatgtggaagttgaaatctggacaaaagaaggggaaaggaagaaattgaaacccagatggttggatgctaggatctactctgacccactggcgctaaaagaattcaaagaatttgcagccggaagaaagtctctgaccctgaacctaattacagaaatgggtaggcttccaacgttcatgacccagaagacaagagacgcactggacaacttagcagtgctgcacacggccgaagcaggtggaagggcgtacaatcatgctctcagtgaactgccggagaccctggagacactgcttttactgacacttctggccacagtcacgggagggatctttttattcttgatgagcgggaggggcatagggaagatgaccctaggaatgtgctgcatagtcacggctagcatcctcctatggtacgcacaaatacagccgcactggatagcagcttcaataatactggagttttttctcatagttttgctcattccagaaccagaaaaacagagaacaccccaagacaaccaattgacctatgttgtcatagctatcctcacagtggtggccgcaaccatggcaaacgagatgggcttcctagaaaagacgaagaaagatcttggattaggaagcattgcaacccagcagcccgagagcaacatcctggacatagatctacgccccgcatcagcatggacgctgtatgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagctccccttctcgccattggatgctactcacaagtcaatcccataactctcacagcagctcttctcttattggtagcgcattatgccattatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagcaatgctcttagtcctctgcgtgactcaagtattgatgatgaggactacatgggctctgtgtgaggccctaaccttagctaccgggcccatctccacactgtgggaaggaaatccaggaaggttctggaacactaccattgcggtgtcaatggctaacatctttagagggagttacttagctggagctggacttctcttttccattatgaagaacacaaccaactcaagaaggggaactggcaacataggagagacgcttggagagaaatggaaaagccgattgaacgcactgggaaaaagtgaattccagatctacaagaaaagtggaatccaggaggtggatagaaccttagcaaaagaaggcattaaaagaggagaaacggaccatcacgctgtgtcgcgaggctcagcaaaactgagatggttcgttgagagaaatatggtcacaccagaagggaaagtagtggacctcggttgtggcagaggaggctggtcatattactgtggaggactaaaaaacgtaagagaagtgaaaggcctaacaaaaggaggaccaggacacgaagaacccatccctatgtcaacatatgggtggaatctagtgcgtcttcaaagtggagttgacgttttcttcatcccgccagaaaagtgtgacacattgttgtgtgacataggggagtcatcaccaaatcctacagtggaagcaggacgaacactcagagtccttaatttggtagaaaattggttgaacaacaacactcaattttgcataaaagttcttaacccatacatgccctcagttatagaaaaaatggaaacactgcaaaggaaatatggaggagccttagtgagaaatccactctcacggaactccacacatgagatgtactgggtttccaatgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaatctagacataattgggaaaagaatagaaaaaataaagcaagagcatgaaacatcatggcactacgaccaagaccacccatataaaacatgggcataccatggcagctatgaaacaaaacagactggatcagcatcatccatggtcaatggagtggtcaggctgttgacaaaaccttgggacgtcctccccaccgtgacacagatggcaatgacagacacgactccatttggacaacagcgtgtttttaaagaaaaagtggacacgagaactcaagaaccgaaagaaggcacgaagaaactaatgaaaatcacagcagagtggctgtggaaggaattagggaagaaaaagacacctaggatgtgcaccagagaagaatttacaagaaaggtgagaagcaatgcagccctgggggccatattcactgatgagaacaagtggaagtcggcacgtgaggctgttgaagatagcaggttttgggagctggttgacaaggaaaggaatctccatcttgaaggaaagtgtgaaacatgtgtgtacaacatgatgggaaaaagagaaaagaaactaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctgagagacgtgagcaagaaagagggaggagccatgtatgccgatgacacagcaggatgggacacaagaattacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtgggcaagttggtacctatggactcaacactttcaccaatatggaagcccaattaatcagacagatggagggagaaggagtttttaaaaacattcagcacctgacagtcacagaagagatcgccgtgcagaactggttagcaagagtggggcgcgaaaggttatcaagaatggccatcagtggagatgattgtgttgtgaaacctttagatgacaggttcgcgagcgctttgacagctctaaatgacatgggaaagattagaaaagacatacaacaatgggaaccttcaagaggatggaacgattggacacaagtgcccttctgttcacaccatttccatgaactaatcatgaaggatggtcgtgtacttgttgttccatgcagaaaccaagatgaactgattggcagagcccgaatctcccaaggagcagggtggtccttgcgggagacggcctgtttggggaagtcttacgcccaaatgtggagcttgatgtatttccacagacgcgacctcaggttggcggcaaatgccatttgctcggcagtgccatcacattgggttccaacaagtcgaacaacctggtccatacacgccaaacatgaatggatgacaacggaagacatgctgacagtctggaatagggtgtggattcaagaaaacccatggatggaagacaaaacccctgtagaatcatgggaggaaatcccgtacttggggaaaagagaagatcaatggtgcggctcattgattgggttaacaagcagggccacatgggcaaagaacatccaagcagcaataaatcaagttagatctcttataggcaatgaggaatacacagactacatgccatccatgaaaagattcagaagagaagaggaagaagcaggagtcctgtggtag

SEQ ID NO: 6699 - RNA, 9876 nt, synthetic construct
  misc_feature 1..9876: note = derived and/or modified CDS sequence (wt) from DENV-2__FJ687439__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggattctgagacatccaggcttcaccataatggcagcaatcctggcatacaccatagggacgacacatttccagagagccctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacaatagtcatcagagtgcaatatgaaggggacggctctccatgtaaaatcccttttgagataatggatttggaaaaaagatatgtcttaggccgcctgatcacagtcaacccaattgcaacagaaaaagatagcccagtcaacatagaagcagaacctccattcggagacagctacatcatcataggagtagagccgggacaactgaagctcaactggttcaagaaaggaagttctatcggccaaatgtttgagacgacgatgagaggggcgaagagaatggccattttgggtgacacagcctgggacttcggatccctggggggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtactggtgggaattgtgacactgtacttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgcgggatccgctcggtaacaagattggagaacctaatgtggaaacaaataacaccagaattgaatcacattctagcagaaaatgaggtgaagttaactatcatgacaggagacatcaaaggaatcatgcaagcaggaaaacgatctttgcggcctcagcctactgagctaaagtattcatggaaaacatggggtaaagcaaaaatgctctccacagagtcttataaccaaacctttctcattgatggccccgagacggcagagtgccctaacacaaatagagcttggaactctttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcctgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatggcggatgacataggcatgggcgtgacttatcttgccctactagcagccttcaaagttagaccaacttttgcagctggactactcttgagaaagctgacctccaaggaattgatgatgaccaccataggaattgtactcctctcccaaagcactataccagagaccattcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaaggagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgttggtgatctcaggacttttccctatatcaataccaatcacggcagcagcatggtacctgtgggaagtgaagaaacaacgggccggagtattgtgggacgttccttcacccccacccatgggaaaagctgaactggaagatggagcctatagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattgtcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagagggaatcattcccagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctggaaaaaacgaagaaagatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatatatccctaacagctatagccaaccaagcaacagtattaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatttttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaggtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggaagaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacaaactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacgtgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattagccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagctataaatcaggttagatctcttataggcaatgaggaatacacagattacatgccatccatgaaaagatttagaagagaagaggaagaagcaggagtcctgtggtaa

SEQ ID NO: 6700 - RNA, 9876 nt, synthetic construct
  misc_feature 1..9876: note = derived and/or modified CDS sequence (wt) from DENV-2__FJ687440__SS-prME
  source 1..9876: mol_type = other RNA
tctgcaggcatgatcattatgctgattccaacagtgatggcgttccatctaaccacacgtaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtggataacctatgggacttgtaccactacgggagaacatagaagagaaaaaagatcagtggcactcgttccacatgtgggaatgggactggagacgcgaaccgaaacctggatgtcatcagaaggggcttggaaacatgcccagagaattgaaacttggatcctgagacatccaggcttcaccataatggcagcaatcttggcatacaccatagggacgacacatttccagagagccctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacagggaaacacggcaaggaaatcaaagtaacaccacagagttccatcacagaagctgaattgacaggttatggcaccgtcacgatggagtgctctccgagaacaggcctcgacttcaatgagatggtgttgctgcagatggaaaataaagcttggctggtgcataggcaatggttcctagacctgccattaccgtggctgcccggagcggacaaacaagggtcaaattggatacagaaagaaacattggtcactttcaaaaatccccatgcaaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatacgaaggggacggctctccatgtaaaatcccttttgagataatggatttggaaaaaagatatgtcttaggccgcctaatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcaaagagaatggccattttgggtgacacagcctgggacttcggctccctgggaggagtgtttacatctataggaaaagctctccaccaagtctttggagcaatctatggagctgccttcagtggggtttcatggactatgaaaatcctcataggagtcattatcacatggataggaatgaactcacgcagcacttcactgtctgtgtcactagtattggtgggaattgtgacactgtatttgggagtcatggtgcaggccgatagtggttgcgttgtgagctggaaaaacaaagaactgaaatgtggtagtgggattttcatcacagacaacgtacacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccccgagacggcagaatgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggcaagcttgagatggactttgatttctgcgatggaaccacagtgatagtgaccgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaattctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccattcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatctttctaacaaccctctcaagaaccaacaagaaaaggagctggccgctaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcatcagaacaggattgctggtgatctcaggactttttcctgtatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaactaaacctggtcttttcaaaactaacaccggaacaataggtgccgtatctctggacttttcccctggaacgtcaggatctccaatcattgataaaaaaggaaaagttgtgggtctttatggtaatggtgttgtcacaaggagtggagcatatgtgagtgctatagcccaaactgaaaaaagcattgaagacaaccccgaaatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggttacggattttacagggaagactgtttggttcgttccaagcataaaagcaggaaatgatatagcagcttgcctgagaaaaaatggaaagaaagtaatacaactcagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcccagtatgtttgaaccagagcgtgaaaaagtggatgccattgatggcgaataccgcttgagaggagaagcaaggaaaacctttgtggacttaatgaggagaggagacctaccagtctggttggcttacaaagtggcagctgaaggcatcaactatgcagacagaaggtggtgttttgatggaattaagaacaaccaaatcctggaagaaaatgtggaagttgaaatctggacaaaagaaggagaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgctcttactgacacttctggctacagtcacaggagggatttttttattcttgatgagcgggaggggcatagggaagatgaccctgggaatgtgctgcataattacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaatccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaatgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtctccagagtggagttgacgtcttcttcatcccgccagaaaagtgtgacacattattgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcggtgaacatgatttcaaggatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggcactacgatcaggaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccattcggacaacagcgtgtttttaaagaaaaagtggacacgagaacccaagaaccgaaagaaggcacgaagaaattaatgaaaatcacagcagaatggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctgagagacgtgagcaagaaagagggaggagccatgtacgccgacgacacagcaggatgggacacaagaatcacactagaagacttaaaaaatgaagaaatggtaacaaaccacatggaaggagaacacaagaaattagccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagccacagaagaaattgccgtgcaaaactggttagcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggctaacaagcagggccacatgggcaaagaacatccaagcagcaataaatcaagttagatctcttataggcaatgaggaatacacagattacatgccatccatgaaaagattcagaagagaagaggaagaagcaggagtcctgtggtaa

SEQ ID NO: 6701 - RNA, 9876 nt, synthetic construct
  misc_feature 1..9876: note = derived and/or modified CDS sequence (wt) from DENV-2__FJ687441__SS-prME
  source 1..9876: mol_type = other RNA
tctgcaggcatgatcattatgctgattccaacagtgatggcgttccatctaaccacacgtaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtggataacctatgggacttgtaccactacgggagaacatagaagagaaaaaagatcagtggcactcgttccacatgtgggaatgggactggagacgcgaaccgaaacctggatgtcatcagaaggggcttggaaacatgcccagagaattgaaacttggatcctgagacatccaggcttcaccataatggcagcaatcttggcatacaccatagggacgacacatttccagagagccctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacagggaaacacggcaaggaaatcaaagtaacaccacagagttccatcacagaagctgaattgacaggttatggcaccgtcacgatggagtgctctccgagaacaggcctcgacttcaatgagatggtgttgctgcagatggaaaataaagcttggctggtgcataggcaatggttcctagacctgccattaccgtggctgcccggagcggacaaacaagggtcaaattggatacagaaagaaacattggtcactttcaaaaatccccatgcaaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatacgaaggggacggctctccatgtaaaatcccttttgagataatggatttggaaaaaagatatgtcttaggccgcctaatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcaaagagaatggccattttgggtgacacagcctgggacttcggctccctgggaggagtgtttacatctataggaaaagctctccaccaagtctttggagcaatctatggagctgccttcagtggggtttcatggactatgaaaatcctcataggagtcattatcacatggataggaatgaactcacgcagcacttcactgtctgtgtcactagtattggtgggaattgtgacactgtatttgggagtcatggtgcaggccgatagtggttgcgttgtgagctggaaaaacaaagaactgaaatgtggtagtgggattttcatcacagacaacgtacacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccccgagacggcagaatgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggcaagcttgagatggactttgatttctgcgatggaaccacagtgatagtgaccgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaattctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccattcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatctttctaacaaccctctcaagaaccaacaagaaaaggagctggccgctaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcatcagaacaggattgctggtgatctcaggactttttcctgtatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaactaaacctggtcttttcaaaactaacaccggaacaataggtgccgtatctctggacttttcccctggaacgtcaggatctccaatcattgataaaaaaggaaaagttgtgggtctttatggtaatggtgttgtcacaaggagtggagcatatgtgagtgctatagcccaaactgaaaaaagcattgaagacaaccccgaaatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcccccgggaagcagagatccatttcctcagagcaatgcaccaatcatagatgaagaaagagaaatccctgaacgttcatggaattctggacatgagtgggttacggattttaaagggaagactgtttggttcgttccaagcataaaagcaggaaatgatatagcagcttgcctgagaaaaaatggaaagaaagtaatacaactcagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcccagtatgtttgaaccagagcgtgaaaaagtggatgccattgatggcgaataccgcttgagaggagaagcaaggaaaacctttgtggacttaatgaggagaggagacctaccagtctggttggcttacaaagtggcagctgaaggcatcaactatgcagacagaaggtggtgttttgatggaattaagaacaaccaaatcctggaagaaaatgtggaagttgaaatctggacaaaagaaggagaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgctcttactgacacttctggctacagtcacaggagggatttttttattcttgatgagcgggaggggcatagggaagatgaccctgggaatgtgctgcataattacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaatccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaatgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtctccagagtggagttgacgtcttcttcatcccgccagaaaagtgtgacacattattgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcggtgaacatgatttcaaggatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggcactacgatcaggaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccattcggacaacagcgtgtttttaaagaaaaagtggacacgagaacccaagaaccgaaagaaggcacgaagaaattaatgaaaatcacagcagaatggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctgagagacgtgagcaagaaagagggaggagccatgtacgccgacgacacagcaggatgggacacaagaatcacactagaagacttaaaaaatgaagaaatggtaacaaaccacatggaaggagaacacaagaaattagccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagccacagaagaaattgccgtgcaaaactggttagcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggctaacaagcagggccacatgggcaaagaacatccaagcagcaataaatcaagttagatctcttataggcaatgaggaatacacagattacatgccatccatgaaaagattcagaagagaagaggaagaagcaggagtcctgtggtaa

SEQ ID NO: 6702 - RNA, 9876 nt, synthetic construct
  misc_feature 1..9876: note = derived and/or modified CDS sequence (wt) from DENV-2__FJ687445__SS-prME
  source 1..9876: mol_type = other RNA
tctgtaggcatgatcattatgctgattccaacagtaatggcgttccatctaaccacacgcaacggagaaccacacatgatcgtcagtatacaagagaaaggaaaaagccttctgtttaaaacagaggatggcgtgaacatgtgcaccctcatggccatggaccttggtgaattgtgtgaagacacaatcacgtacaagtgtccccttctcaggcagaatgagccagaagacatagactgctggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagaaccctgattttcatcctactgacagctgtcgctccttcaatgacaatgcgttgcataggaatatcaaatagagactttgtagaaggggtctcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgctgcccaacacaaggggaacccagcctaaaagaagagcaggataagaggttcgtctgcaaacactccatggtagacagaggatggggaaatggatgtggattatttggaaaaggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgtcgttgttttaggatcccaagaaggggccatgcatacagcactcacaggagccacagaaatccaaatgtcgtcaggaaacttactcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtacaatatgaaggggacggctctccatgtaaaatcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggttcaagaaaggaagttctatcggccaaatgtttgagacaacaatgaggggggcgaagagaatggccattttgggtgacacagcctgggatttcggatccttgggaggagtgtttacatctataggaaaagccctccaccaagtctttggagcaatctatggagctgccttcagtggggtttcatggactatgaaaatcctcataggagtcattatcacatggataggaatgaactcacgcagcacctcactgtctgtgtcactagtattggtgggagttgtgacactgtatttgggagtcatggtgcaggccgatagtggttgcgtcgtgagctggaaaaacaaagaactgaaatgtggcagtgggattttcatcacagacaacgtgcacacatggacagaacaatacaagttccaaccagaatccccttcaaaactagcttcagccatccaaaaagctcaagaagagggaatttgtgggatccgctcagtaacaagattggagaacctaatgtggaaacaaataacaccagaattgaatcacattctagcagaaaatgaggtgaagttaactattatgacaggagacatcaaaggaatcatgcaggcaggaaaacgatctctgcggcctcagcccactgagctaaagtattcatggaaaacatggggcaaagcaaaaatgctctccacagagtctcataatcaaacctttctcattgatggccccgagacagcagaatgccccaacacaaatagagcttggaactcgttggaagttgaagactacggttttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaggcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactaggagtcttgggaatggcactgttcctggaggaaatgcttaggacccgagtaggaacgaaacatgcgatactactagttgcagtttcttttgtgacattgatcacagggaacatgtcctttaaagatctaggaagagtggtggttatggtaggcgccaccatgacggatgacataggtatgggcgtaacttatcttgccctactagcagccttcaaagtcagaccaacttttgcagcaggactattcttgagaaagctgacctccaaggaattgatgatgactaccataggaattgtactcctctcccagagcactataccagaaaccatccttgaattgactgatgcgttagccttaggcatgatggtcctcaaaatggtaagagacatggaaaagtatcaattagcagtgaccatcatggctatcttgtgcgtcccaaatgcagtgatattacaaaatgcatggaaagtgagttgcacaatactagcagtggtgtccgtttccccactgcttttgacatcctcacagcaaaaaacggattggataccattagcattgacaatcaagggtctcaatccaacagccatctttctgacaaccctctcaagaaccaacaagaaaaggagctggccactaaatgaggctatcatggcagtcggaatggtgagcattttagccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacagcagcagcatggtacctgtgggaagtgaagaaacaacgggccggagtattgtgggatgttccttcacccccacccatgggaaaggctgaactggaagatggagcctacagaatcaagcaaagagggattcttggatattcccagatcggagctggagtttataaagaaggaacattccatacgatgtggcatgtcacacgtggcgctgtcctaacgcataaaggaaagaggattgaaccatcatgggcggacgttaaaaaagatctaatatcatatggaggaggctggaagctagaaggagaatggaaggaaggagaagaagtccaggtgctggcattggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatacgtgagtgccatagcccaaactgaaaaaagcattgaagacaacccagacatcgaagacgacattttccgaaagagaagactgaccatcatggacctccacccaggagcgggaaagacgaaaagataccttccggccatagtcagagaagctataaaacggggtttgagaacattaatcttggcccccaccagagttgtggcagctgaaatggaggaagctctcagaggactcccaataagataccaaaccccagccatcagagctgagcacacagggcgggaaattgtggatctaatgtgtcatgccacatttaccatgaggctgctatcaccagttagagtgccaaactacaacctgattatcatggatgaagcccatttcacagacccagcaagtatagcagctagaggatacatctcaactcgagtggagatgggtgaagcagctgggattttcatgacagccactcccccgggaagcagagatccatttcctcagagcaatgcaccaatcatagatgaagaaagagaaatccctgaacgttcatggaattctggacatgagtgggtcacggattttaaagggaaaactgtttggtttgttccaagcataaaagcaggaaatgatatagcagcctgcctgagaaagaatggaaagaaagtaatacaacttagcaggaagacttttgattctgagtatgtcaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacctatgccagtgactcactctagtgcagcacaaagaagagggagaataggaagaaatccaaaaaatgaaaatgatcagtacatatacatgggggaacctctggaaaatgatgaagactgtgcacactggaaagaagccaaaatgctcctagataacattaacacaccagaaggaatcattcccagtatgtttgaaccagagcgtgaaaaagtggacgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaatcaagaacaaccaaatcctggaagagaatgtggaagttgaaatctggacaaaagaaggggaaaggaagaaattgaaaccccgatggttggatgctaggatctactctgacccactggcgctaaaagaattcaaagaatttgcagccggaagaaagtctctgaccctgaacctaattacagaaatgggtaggcttccaacgttcatgacccagaagacaagagacgcactggataacttagcagtgctgcacacggccgaagcaggtggaagggcgtacaatcatgctctcagtgaactgccggagaccctggagacactgcttttactgacacttctggccacagtcacgggagggatctttttattcttgatgagcgggaggggcatagggaagatgaccctaggaatgtgctgcatagtcacggctagcatccttctatggtacgcacaaatacagccacactggatagcagcttcaataatactggagttttttctcatagttttgctcattccagaaccagaaaaacagagaacaccccaagacaaccaattgacctatgttgtcatagccatcctcacagtggtggccgcaaccatggcaaacgagatgggtttcctagaaaagacgaagaaagatcttggattaggaagcattgcaacccagcagcccgagagcaacatcctggacatagatctacgccccgcatcagcatggacgctgtatgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagctccccttctcgccattggatgctactcacaagtcaatcccataactctcacagcagctcttctcttattggtagcgcattatgccattatagggccaggacttcaagcaaaagcaaccagagaagcccagaaaagagcagcggcgggcatcatgaaaaacccaaccgtcgatggaataacagtgattgatctagatccaatacctcatgatccaaagtttgaaaagcagttgggacaagtaatgctcctagtcctctgcgtgactcaagtattgatgatgaggactacatgggctctgtgtgaggccttaaccttagctaccgggcccatctccacactgtgggaaggaaatccaggaaggttctggaacactaccattgcggtgtcaatggctaacatctttagagggagttacttggctggagctggacttctcttttccattatgaagaacacaaccaactcaagaaggggaactggcaacataggagagacgcttggagagaaatggaaaagccgattgaacgcactgggaaaaagtgaattccagatctacaagaaaagtggaatccaggaggtggatagaaccttagcaaaagaaggcattaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgccttcaaagtggagttgacgttttcttcatcccgccagaaaagtgtgacacattgttgtgtgacataggggagtcatcaccaaatcctacagtggaagcaggacgaacactcagagtccttaatttggtagaaaattggttgaacaacaacactcaattttgcataaaagttcttaacccatacatgccctcagttatagaaaaaatggaaacactgcaaaggaaatatggaggagccttagtgagaaatccactctcacggaactccacacatgagatgtactgggtttccaatgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaatctagacataattgggaaaagaatagaaaaaataaagcaagagcatgaaacatcatggcactacgaccaagaccacccatataaaacatgggcataccatggcagctatgaaacaaaacagactggatcagcatcatccatggtcaatggagtggtcaggctgttgacaaaaccttgggacgtcctccccaccgtgacacagatggcaatgacagacacgactccatttggacaacagcgtgtttttaaagaaaaagtggacacgagaactcaagaaccgaaagaaggcacgaagaaactaatgaaaatcacagcagagtggctgtggaaggaattagggaagaaaaagacacctaggatgtgcaccagagaagaatttacaagaaaggtgagaagcaatgcagccttgggggccatattcactgatgagaataagtggaagtcggcacgtgaggctgttgaagatagcaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaggctaggttacattctgagagacgtgagcaagaaagagggaggagccatgtatgccgatgacacagcaggatgggacacaagaattacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtgggcaagttggtacctatggactcaacactttcaccaatatggaagcccaattaatcagacagatggagggagaaggagtttttaaaaacattcagcacctgacagtcacagaagaaatcgccgtgcagaactggttagcaagagtggggcgcgaaaggttatcaagaatggccatcagtggagatgattgtgttgtgaaacctttagatgacaggttcgcgagcgctttgacagctctaaatgacatgggaaagattagaaaagacatacaacaatgggaaccttcaagaggatggaacgattggacacaagtgcccttctgttcacaccatttccatgaactaatcatgaaggatggtcgtgtacttgttgttccatgcagaaaccaagatgaactgattggcagagcccgaatctcccaaggagcagggtggtccttgcgggagacggcctgtttggggaagtcttacgcccaaatgtggagcttgatgtatttccacagacgcgacctcaggttagcggcaaatgccatttgctcggcagtgccatcacattgggttccaacaagtcgaacaacctggtccatacacgccaaacatgaatggatgacaacggaagacatgctgacagtctggaatagggtgtggattcaagaaaacccatggatggaagacaaaaccccagtagaatcatgggaggaaatcccgtacttggggaaaagagaagatcaatggtgcggctcattgattgggttaacaagcagggccacatgggcaaagaacatccaagtagcaataaatcaagttagatctcttataggcaatgaggaatacacagactacatgccatccatgaaaagattcagaagagaagaggaagaagcaggagtcctgtggtag

SEQ ID NO: 6703 - RNA, 9876 nt, synthetic construct
  misc_feature 1..9876: note = derived and/or modified CDS sequence (wt) from DENV-2__FJ687447__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtgacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaataaaccaacattggatttcgaattgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggcaaggaaatcaaagtaacaccacagagttccatcacagaagcagaattgacaggttatggcaccgtcacgatggagtgctctccgagaacaagcctcgacttcaatgagatggtgttgctgcagatggaaaataaagcttggctggtgcataggcaatggtttctagacctgccattaccatggctgcccggagcggataaacaagagtcaaattggatacagaaagaaacattggtcaccttcaaaaatccccatgcgaagaaacaggatgttgttgttttaggatcccaagaaggggccatgcatacagcactcacaggagccacagaaatccaaatgtcgtcaggaaacttgctcttcactgggcatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtttttggagcaatctatggagctgccttcagtggtgtttcatggactatgaaaatcctcataggagtcattatcacatggataggaatgaactcacgcagcacctcactgtctgtgtcactagtactggtgggaattgtgacactgtatttgggagtcatggtgcaggccgatagcggttgcgttgtgagctggaaaaacaaagaactgaaatgtggcagtgggattttcatcacagacaacgtgcacacatggacagaacaatacaagttccaaccagaatccccttcaaaactagcttcagctatccaaaaagctcaagaagagggaatttgtgggatccgctcggtaacaagattggagaacctaatgtggaaacaaataacaccagaattgaatcacattctagcagaaaatgaggtgaagttaactatcatgacaggagacatcaaaggaatcatgcaggcaggaaaacgatctttgcggccccagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggacttcgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatggacaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccattcttgaattgactgatgcgttagccttaggcatgatggtccttaaaatagtaagaaacatggaaaagtaccaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaaggagctggccactaaatgaggctatcatggcagtcggaatggtgagcattttagccagttccctcctaaaaaatgatattcccatgacaggaccactagtggctggagggctcctcactgtgtgctacgtgctcactggacgatcggcagacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccataggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgagactgctatcaccagttagagtgccaaactacaacttgattatcatggacgaagcccatttcacagacccagcaagtatagcagctagaggatacatctcaacccgagttgagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcccagtatgtttgaaccagagcgtgaaaaagtggatgccattgatggcgaataccgtttgagaggagaagcaaggaaaacctttgtggacttaatgaggagaggagacttaccagtctggttggctttcaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttagatgctaggatctactctgacccactggcgttaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacactgctggctacagtcacaggagggatctttctatttttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacaccaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcctctgggaacatagtgtcatcagtgaacatgatttcaaggatgttgatcaacagattcacaatgagacacaagaaagccacttatgagccggatgttgacctcggaagcggaacccgtaacattggaattgaaagtgaaataccaaacctagacataattgggaaaagaatagaaaaaataaagcaagagcatgaaacatcatggcactacgaccaagaccacccatacaagacgtgggcataccatggtagctacgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttttccagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccagtggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6704 - RNA, 9876 nt, synthetic construct
  misc_feature 1..9876: note = derived and/or modified CDS sequence (wt) from DENV-2__FJ810411__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtgacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaataaaccaacattggatttcgaattgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggcaaggaaatcaaagtaacaccacagagttccatcacagaagcagaattgacaggttatggcaccgtcacgatggagtgctctccgagaacaagcctcgacttcaatgagatggtgttgctgcagatggaaaataaagcttggctggtgcataggcaatggtttctagacctgccattaccatggctgcccggagcggataaacaagagtcaaattggatacagaaagaaacattggtcaccttcaaaaatccccatgcgaagaaacaggatgttgttgttttaggatcccaagaaggggccatgcatacagcactcacaggagccacagaaatccaaatgtcgtcaggaaacttgctcttcactgggcatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtttttggagcaatctatggagctgccttcagtggtgtttcatggactatgaaaatcctcataggagtcattatcacatggataggaatgaactcacgcagcacctcactgtctgtgtcactagtactggtgggaattgtgacactgtatttgggagtcatggtgcaggccgatagcggttgcgttgtgagctggaaaaacaaagaactgaaatgtggcagtgggattttcatcacagacaacgtgcacacatggacagaacaatacaagttccaaccagaatccccttcaaaactagcttcagctatccaaaaagctcaagaagagggaatttgtgggatccgctcggtaacaagattggagaacctaatgtggaaacaaataacaccagaattgaatcacattctagcagaaaatgaggtgaagttaactatcatgacaggagacatcaaaggaatcatgcaggcaggaaaacgatctttgcggccccagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatggacaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccattcttgaattgactgatgcgttagccttaggcatgatggtccttaaaatagtaagaaacatggaaaagtaccaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaaggagctggccactaaatgaggctatcatggcagtcggaatggtgagcattttagccagttccctcctaaaaaatgatattcccatgacaggaccactagtggctggagggctcctcactgtgtgctacgtgctcactggacgatcggcagacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccataggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgagactgctatcaccagttagagtgccaaactacaacttgattatcatggacgaagcccatttcacagacccagcaagtatagcagctagaggatacatctcaacccgagttgagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcccagtatgtttgaaccagagcgtgaaaaagtggatgccattgatggcgaataccgtttgagaggagaagcaaggaaaacctttgtggacttaatgaggagaggagacttaccagtctggttggctttcaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttagatgctaggatctactctgacccactggcgttaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacactgctagctacagtcacaggagggatctttctatttttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacaccaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcctctgggaacatagtgtcatcagtgaacatgatttcaaggatgttgatcaacagattcacaatgagacacaagaaagccacttatgagccggatgttgacctcggaagcggaacccgtaacattggaattgaaagtgaaataccaaacctagacataattgggaaaagaatagaaaaaataaagcaagagcatgaaacatcatggcactacgaccaagaccacccatacaagacgtgggcataccatggtagctacgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagaatggctgtggaaagaactagggaagaaaaagacacctaggatgtgcaccagagaagaattcacaaaaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttttccagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccagtggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6705 - RNA, 9876 nt, synthetic construct
  misc_feature 1..9876: note = derived and/or modified CDS sequence (wt) from DENV-2__FJ744713__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtgacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaataaaccaacattggatttcgaattgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggcaaggaaatcaaagtaacaccacagagttccatcacagaagcagaattgacaggttatggcaccgtcacgatggagtgctccccgagaacaagcctcgacttcaatgagatggtgttgctgcagatggaaaataaagcttggctggtgcataggcaatggtttctagacctgccattaccatggctgcccggagcggataaacaagagtcaaattggatacagaaagaaacattggtcaccttcaaaaatccccatgcgaagaaacaggatgttgttgttttaggatcccaagaaggggccatgcatacagcactcacaggagccacagaaatccaaatgtcgtcaggaaacttgctcttcactgggcatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtttttggagcaatctatggagctgccttcagtggtgtttcatggactatgaaaatcctcataggagtcattatcacatggataggaatgaactcacgcagcacctcactgtctgtgtcactagtactggtgggaattgtgacactgtatttgggagtcatggtgcaggccgatagcggttgcgttgtgagctggaaaaacaaagaactgaaatgtggcagtgggattttcatcacagacaacgtgcacacatggacagaacaatacaagttccaaccagaatccccttcaaaactagcttcagctatccaaaaagctcaagaagagggaatttgtgggatccgctcggtaacaagattggagaacctaatgtggaaacaaataacaccagaattgaatcacattctagcagaaaatgaggtgaagttaactatcatgacaggagacatcaaaggaatcatgcaggcaggaaaacgatctttgcggccccagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatggacaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccattcttgaattgactgatgcgttagccttaggcatgatggtccttaaaatagtaagaaacatggaaaagtaccaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaaggagctggccactaaatgaggctatcatggcagtcggaatggtgagcattttagccagttccctcctaaaaaatgatattcccatgacaggaccactagtggctggagggctcctcactgtgtgctacgtgctcactggacgatcggcagacttggaactggagagagcaaccgatgtcaaatgggaagaccaggcagagatatcaggaagcagtccaatcctgtcaataacaatatcagaagatggtagcatgtcgataaaaaatgaagaggaagaacaaatactgaccatactcattagaacaggattgctggtgatctcaggactttttcctatatcaataccaatcacggcagcagcatggtacctgtgggaagtgaagaaacaacgggccggagtattgtgggacgttccttcacccccacccataggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgagactgctatcaccagttagagtgccaaactacaacttgattatcatggacgaagcccatttcacagacccagcaagtatagcagctagaggatacatctcaacccgagttgagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcccagtatgtttgaaccagagcgtgaaaaagtggatgccattgatggcgaataccgtttgagaggagaagcaaggaaaacctttgtggacttaatgaggagaggagacttaccagtctggttggctttcaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttagatgctaggatctactctgacccactggcgttaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacactgctggctacagtcacaggagggatctttctatttttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacaccaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcctctgggaacatagtgtcatcagtgaacatgatttcaaggatgttgatcaacagattcacaatgagacacaagaaagccacttatgagccggatgttgacctcggaagcggaacccgtaacattggaattgaaagtgaaataccaaacctagacataattgggaaaagaatagaaaaaataaagcaagagcatgaaacatcatggcactacgaccaagaccacccatacaagacgtgggcataccatggtagctacgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttttccagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccagtggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6706 - RNA, 9876 nt, synthetic construct
  misc_feature 1..9876: note = derived and/or modified CDS sequence (wt) from DENV-2__FJ744714__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggacaagaggttcgtctgcaaacactccatggtagacagaggatggggaaatggatgtggattatttggaaaggggggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatctctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactacagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctaccatggcggatgacataggtatgggcgtgacttatcttgccctactagcagctttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaaaggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggcctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgctgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgtaacattggaattgaaagtgaagtaccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacctgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6707 - RNA, 9876 nt, synthetic construct
  misc_feature 1..9876: note = derived and/or modified CDS sequence (wt) from DENV-2__FJ744716__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacacgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggacaagaggttcgtctgcaaacactccatggtagacagaggatggggaaatggatgtggattatttggaaaggggggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatctctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactacagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctaccatggcggatgacataggtatgggcgtgacttatcttgccctactagcagctttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaaaggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcgcacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggcctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctataagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgctgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatctcaaggatgttgatcaatagattcacaatgagacacaagaaagccacttacgagccggatgttgacctcggaagcggaacccgtaacattggaattgaaagtgaagtaccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaatgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacctgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6708 - RNA, 9876 nt, synthetic construct
  misc_feature 1..9876: note = derived and/or modified CDS sequence (wt) from DENV-2__FJ744718__SS-prME
  source 1..9876: mol_type = other RNA
tctgcaggcatgatcattatgttgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggacaagaggttcgtctgcaaacactccatggtagacagaggatggggaaatggatgtggattatttggaaaggggggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggtcgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggatttcggatctctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagataacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccctaacacaaatagagcttggaattcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactacagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctaccatggcggatgacataggtatgggcgtgacttatcttgccctactagcagctttcaaagttagaccaacttttgcagctggactactcttgagaaaactgacctccaaggaattgatgatgactaccataggaattgtactcctctcccaaagcactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggcctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaagtccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgctgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgtaacattggaattgaaagtgaagtaccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaactggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacctgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6709 - RNA, 9876 nt, synthetic construct
  misc_feature 1..9876: note = derived and/or modified CDS sequence (wt) from DENV-2__FJ744722__SS-prME
  source 1..9876: mol_type = other RNA
tctgtaggcatgatcattatgctgattccaacagtaatggcgttccatctaaccacacgcaacggagaaccacacatgatcgtcagtatacaagagaaaggaaaaagccttctgtttaaaacagaggatggcgtgaacatgtgcaccctcatggccatggaccttggtgaattgtgtgaagacacaatcacgtacaagtgtccccttctcaggcagaatgagccagaagacatagactgctggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagaaccctgattttcatcctactgacagctgtcgctccttcaatgacaatgcgttgcataggaatatcaaatagagactttgtagaaggggtctcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgctgcccaacacaaggggaacccaacctaaaagaagagcaggataagaggttcgtctgcaaacactccatggtagacagaggatggggaaatggatgtggattatttggaaaaggaggcattgtgacctgtgctatgttcacatgcaaaaagaacatggaagggaaaatcgtgcaaccagaaaacttggaatacaccattgtggtaacaccccactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctaccattaccatggctgcccggagcggatacacaagggtcaaattggatacagaaagaaacattggtcactttcaaaaatccccatgcgaagaaacaggatgtcgttgttttaggatcccaagaaggggccatgcatacagcactcacaggagccacagaaatccaaatgtcgtcaggaaacttactcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtacaatatgaaggggacggctctccatgtaaaatcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggttcaagaaaggaagttctatcggccaaatgtttgagacaacaatgaggggggcgaagagaatggccattttgggtgacacagcctgggatttcggatccttgggaggagtgtttacatctataggaaaagccctccaccaagtctttggagcaatctatggagctgccttcagtggggtttcatggactatgaaaatcctcataggagtcattatcacatggataggaatgaactcacgcagcacctcactgtctgtgtcactagtattggtgggggttgtgacactgtatttgggagtcatggtgcaggccgatagtggttgcgtcgtgagctggaaaaacaaagaactgaaatgtggcagtgggattttcatcacagacaacgtgcacacatggacagaacaatacaagttccaaccagaatccccttcaaaactagcttcagccatccaaaaagctcaagaagagggaatttgtgggatccgctcagtaacaagattggagaacctaatgtggaaacaaataacaccagaattgaatcacattctagcagaaaatgaggtgaagttaactattatgacaggagacatcaaaggaatcatgcaggcaggaaaacgatctctgcggcctcagcccactgagctaaagtattcatggaaaacatggggcaaagcaaaaatgctctccacagagtctcataatcaaacctttctcattgatggccccgagacagcagaatgccccaacacaaatagagcttggaactcgttggaagttgaagactacggttttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaggcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactaggagtcttgggaatggcactgttcctggaggaaatgcttaggacccgagtaggaacgaaacatgcgatactactagttgcagtttcttttgtgacattgatcacagggaacatgtcctttaaagatctaggaagagtggtggttatggtaggcgccaccatgacggatgacataggtatgggcgtaacttatcttgccctactagcagccttcaaagtcagaccaacttttgcagcaggactattcttgagaaagctgacctccaaggaattgatgatgactaccataggaattgtactcctctcccagagcactataccagaaaccatccttgaattgactgatgcgttagccttaggcatgatggtcctcaaaatggtaagagacatggaaaagtatcaattagcagtgaccatcatggctatcttgtgcgtcccaaatgcagtgatattacaaaatgcatggaaagtgagttgcacaatactagcagtggtgtccgtttccccactgcttttgacatcctcacagcaaaaaacggattggataccattagcattgacaatcaagggtctcaatccaacagccatctttctgacaaccctctcaagaaccaacaagaaaaggagctggccactaaatgaggctatcatggcagtcggaatggtgagcattttagccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacagcagcagcatggtacctgtgggaagtgaagaaacaacgggccggagtattgtgggatgttccttcacccccacccatgggaaaggctgaactggaagatggagcctacagaatcaagcaaagagggattcttggatattcccagatcggagctggagtttataaagaaggaacattccatacgatgtggcatgtcacacgtggcgctgtcctaacgcataaaggaaagaggattgaaccatcatgggcggacgttaaaaaagatctaatatcatatggaggaggctggaagctagaaggagaatggaaggaaggagaagaagtccaggtgctggcattggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatacgtgagtgccatagcccaaactgaaaaaagcattgaagacaacccagacatcgaagacgacattttccgaaagagaagactgaccatcatggacctccacccaggagcgggaaagacgaaaagataccttccggccatagtcagagaagctataaaacggggtttgagaacattaatcttggcccccaccagagttgtggcagctgaaatggaggaagctctcagaggactcccaataagataccaaaccccagccatcagagctgagcacacagggcgggaaattgtggatctaatgtgtcatgccacatttaccatgaggctgctatcaccagttagagtgccaaactacaacctgattatcatggatgaagcccatttcacagacccagcaagtatagcagctagaggatacatctcaactcgagtggagatgggtgaagcagctgggattttcatgacagccactcccccgggaagcagagatccatttcctcagagcaatgcaccaatcatagatgaagaaagagaaatccctgaacgttcatggaattctggacatgagtgggtcacggattttaaagggaaaactgtttggtttgttccaagcataaaagcaggaaatgatatagcagcctgcctgagaaagaatggaaagaaagtaatacaacttagcaggaagacttttgattctgagtatgtcaagactagaaccaatgattgggatttcgtggttacaactgacatttcagaaatgggagccaatttcaaggctgagagggttatagaccccagacgctgcatgaaaccagtcatactaacagatggtgaggagcgggtgattctggcaggacctatgccagtgactcactctagtgcagcacaaagaagagggagaataggaagaaatccaaaaaatgaaaatgatcagtacatatacatgggggaacctctggaaaatgatgaagactgtgcacactggaaagaagccaaaatgctcctagataacattaacacaccagaaggaatcattcccagtatgtttgaaccagagcgtgaaaaagtggacgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaatcaagaacaaccaaatcctggaagagaatgtggaagttgaaatctggacaaaagaaggggaaaggaagaaattgaaaccccgatggttggatgctaggatctactctgacccactggcgctaaaagaattcaaagaatttgcagccggaagaaagtctctgaccctgaacctaattacagaaatgggtaggcttccaacgttcatgacccagaagacaagagacgcactggataacttagcagtgctgcacacggccgaagcaggtggaagggcgtacaatcatgctctcagtgaactgccggagaccctggagacactgcttttactgacacttctggccacagtcacgggagggatctttttattcttgatgagcgggaggggcatagggaagatgaccctaggaatgtgctgcatagtcacggctagcatccttctatggtacgcacaaatacagccacactggatagcagcttcaataatactggagttttttctcatagttttgctcattccagaaccagaaaaacagagaacaccccaagacaaccaattgacctatgttgtcatagccatcctcacagtggtggccgcaaccatggcaaacgagatgggtttcctagaaaagacgaagaaagatcttggattaggaagcattgcaacccagcagcccgagagcaacatcctggacatagatctgcgccccgcatcagcatggacgctgtatgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagctccccttctcgccattggatgctactcacaagtcaatcccataactctcacagcagctcttctcttattggtagcgcattatgccattatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcccatctccacactgtgggaaggaaatccaggaaggttctggaacactaccattgcggtgtcaatggctaacatctttagagggagttacttggctggagctggacttctcttttccattatgaagaacacaaccaactcaagaaggggaactggcaacataggagagacgcttggagagaaatggaaaagccgattgaacgcactgggaaaaagtgaattccagatctacaagaaaagtggaatccaggaggtggatagaaccttagcaaaagaaggcattaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgccttcaaagtggagttgacgttttcttcatcccgccagaaaagtgtgacacattgttgtgtgacataggggagtcatcaccaaatcctacagtggaagcaggacgaacactcagagtccttaatttggtagaaaattggttgaacaacaacactcaattttgcataaaagttcttaacccatacatgccctcagttatagaaaaaatggaaacactgcaaaggaaatatggaggagccttagtgagaaatccactctcacggaactccacacatgagatgtactgggtttccaatgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaatctagacataattgggaaaagaatagaaaaaataaagcaagagcatgaaacatcatggcactacgaccaagaccacccatacaaaacatgggcataccatggcagctatgaaacaaaacagactggatcagcatcatccatggtcaatggagtggtcaggctgttgacaaaaccttgggacgtcctccccaccgtgacacagatggcaatgacagacacgactccatttggacaacagcgtgtttttaaagaaaaagtggacacgagaactcaagaaccgaaagaaggcacgaagaaactaatgaaaatcacagcagagtggctgtggaaggaattagggaagaaaaagacacctaggatgtgcaccagagaagaatttacaagaaaggtgagaagcaatgcagccttgggggccatattcactgatgagaacaagtggaagtcggcacgtgaggctgttgaagatagcaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaggctaggttacattctgagagacgtgagcaagaaagagggaggagccatgtatgccgatgacacagcaggatgggacacaagaattacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtgggcaagttggtacctatggactcaacactttcaccaatatggaagcccaattaatcagacagatggagggagaaggagtttttaaaaacattcagcacctgacagtcacagaagaaatcgccgtgcagaactggttagcaagagtggggcgcgaaaggttatcaagaatggccatcagtggagatgattgtgttgtgaaacctttagatgacaggttcgcgagtgctttgacagctctaaatgacatgggaaagattagaaaagacatacaacaatgggaaccttcaagaggatggaacgattggacacaagtgcccttctgttcacaccatttccatgaactaatcatgaaggatggtcgtgtacttgttgttccatgcagaaaccaagatgaactgattggcagagcccgaatctcccaaggagcagggtggtccttgcgggagacggcctgtttggggaagtcttacgcccaaatgtggagcttgatgtatttccacagacgcgacctcaggttagcggcaaatgccatttgctcggcagtgccatcacattgggttccaacaagtcgaacaacctggtccatacacgccaaacatgaatggatgacaacggaagacatgctgacagtctggaatagggtgtggattcaagaaaacccatggatggaagacaaaaccccagtagaatcatgggaggaaatcccgtacttggggaaaagagaagatcaatggtgcggctcattgattgggttaacaagcagggccacatgggcaaagaacatccaagtagcaataaatcaagttagatctcttataggcaatgaggaatacacagactacatgccatccatgaaaagattcagaagagaagaggaagaagcaggagtcctgtggtag

SEQ ID NO: 6710 - RNA, 9876 nt, synthetic construct
  misc_feature 1..9876: note = derived and/or modified CDS sequence (wt) from DENV-2__FJ744723__SS-prME
  source 1..9876: mol_type = other RNA
tctgtaggcatgatcattatgctgattccaacagtaatggcgttccatctaaccacacgcaacggagaaccacacatgatcgtcagtatacaagagaaaggaaaaagccttctgtttaaaacagaggatggcgtgaacatgtgcaccctcatggccatggaccttggtgaattgtgtgaagacacaatcacgtacaagtgtccccttctcaggcagaatgagccagaagacatagactgctggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagaaccctgattttcatcctactgacagctgtcgctccttcaatgacaatgcgttgcataggaatatcaaatagagactttgtagaaggggtctcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgctgcccaacacaaggggaacccagcctaaaagaagagcaggataagaggttcgtctgcaaacactccatggtagacagaggatggggaaatggatgtggattatttggaaaaggaggcattgtgacctgtgctatgttcacatgcaaaaagaacatggaagggaaaatcgtgcaaccagaaaacttggaatacaccattgtggtaacaccccactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctaccattaccatggctgcccggagcggatacacaagggtcaaattggatacagaaagaaacattggtcactttcaaaaatccccatgcgaagaaacaggatgtcgttgttttaggatcccaagaaggggccatgcatacagcactcacaggagccacagaaatccaaatgtcgtcaggaaacttactcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtacaatatgaaggggacggctctccatgtaaaatcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggttcaagaaaggaagttctatcggccaaatgtttgagacaacaatgaggggggcgaagagaatggccattttgggtgacacagcctgggatttcggatccttgggaggagtgtttacatctataggaaaagccctccaccaagtctttggagcaatctatggagctgccttcagtggggtttcatggactatgaaaatcctcataggagtcattatcacatggataggaatgaactcacgcagcacctcactgtctgtgtcactagtattggtgggagttgtgacactgtatttgggagtcatggtgcaggccgatagtggttgcgtcgtgagctggaaaaacaaagaactgaaatgtggcagtgggattttcatcacagacaacgtgcacacatggacagaacaatacaagttccaaccagaatccccttcaaaactagcttcagccatccaaaaagctcaagaagagggaatttgtgggatccgctcagtaacaagattggagaacctaatgtggaaacaaataacaccagaattgaatcacattctagcagaaaatgaggtgaagttaactattatgacaggagacatcaaaggaatcatgcaggcaggaaaacgatctctgcggcctcagcccactgagctaaagtattcatggaaaacatggggcaaagcaaaaatgctctccacagagtctcataatcaaacctttctcattgatggccccgagacagcagaatgccccaacacaaatagagcttggaactcgttggaagttgaagactacggttttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaggcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactaggagtcttgggaatggcactgttcctggaggaaatgcttaggacccgagtaggaacgaaacatgcgatactactagttgcagtttcttttgtgacattgatcacagggaacatgtcctttaaagatctaggaagagtggtggttatggtaggcgccaccatgacggatgacataggtatgggcgtaacttatcttgccctactagcagccttcaaagtcagaccaacttttgcagcaggactattcttgagaaagctgacctccaaggaattgatgatgactaccataggaattgtactcctctcccagagcactataccagaaaccatccttgaattgactgatgcgttagccttaggcatgatggtcctcaaaatggtaagagacatggaaaagtatcaattagcagtgaccatcatggctatcttgtgcgtcccaaatgcagtgatattacaaaatgcatggaaagtgagttgcacaatactagcagtggtgtccgtttccccactgcttttgacatcctcacagcaaaaaacggattggataccattagcattgacaatcaagggtctcaatccaacagccatctttctgacaaccctctcaagaaccaacaagaaaaggagctggccactaaatgaggctatcatggcagtcggaatggtgagcattttagccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacagcagcagcatggtacctgtgggaagtgaagaaacaacgggccggagtattgtgggatgttccttcacccccacccatgggaaaggctgaactggaagatggagcctacagaatcaagcaaagagggattcttggatattcccagatcggagctggagtttataaagaaggaacattccatacgatgtggcatgtcacacgtggcgctgtcctaacgcataaaggaaagaggattgaaccatcatgggcggacgttaaaaaagatctaatatcatatggaggaggctggaagctagaaggagaatggaaggaaggagaagaagtccaggtgctggcattggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatacgtgagtgccatagcccaaactgaaaaaagcattgaagacaacccagacatcgaagacgacattttccgaaagagaagactgaccatcatggacctccacccaggagcgggaaagacgaaaagataccttccggccatagtcagagaagctataaaacggggtttgagaacattaatcttggcccccaccagagttgtggcagctgaaatggaggaagctctcagaggactcccaataagataccaaaccccagccatcagagctgagcacacagggcgggaaattgtggatctaatgtgtcatgccacatttaccatgaggctgctatcaccagttagagtgccaaactacaacctgattatcatggatgaagcccatttcacagacccagcaagtatagcagctagaggatacatctcaactcgagtggagatgggtgaagcagctgggattttcatgacagccactcccccgggaagcagagatccatttcctcagagcaatgcaccaatcatagatgaagaaagagaaatccctgaacgttcatggaattctggacatgagtgggtcacggattttaaagggaaaactgtttggtttgttccaagcataaaagcaggaaatgatatagcagcctgcctgagaaagaatggaaagaaagtaatacaacttagcaggaagacttttgattctgagtatgtcaagactagaaccaatgattgggatttcgtggttacaactgacatttcagaaatgggagccaatttcaaggctgagagggttatagaccccagacgctgcatgaaaccagtcatactaacagatggtgaggagcgggtgattctggcaggacctatgccagtgactcactctagtgcagcacaaagaagagggagaataggaagaaatccaaaaaatgaaaatgatcagtacatatacatgggggaacctctggaaaatgatgaagactgtgcacactggaaagaagccaaaatgctcctagataacattaacacaccagaaggaatcattcccagtatgtttgaaccagagcgtgaaaaagtggacgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaatcaagaacaaccaaatcctggaagagaatgtggaagttgaaatctggacaaaagaaggggaaaggaagaaattgaaaccccgatggttggatgctaggatctactctgacccactggcgctaaaagaattcaaagaatttgcagccggaagaaagtctctgaccctgaacctaattacagaaatgggtaggcttccaacgttcatgacccagaagacaagagacgcactggataacttagcagtgctgcacacggccgaagcaggtggaagggcgtacaatcatgctctcagtgaactgccggagaccctggagacactgcttttactgacacttctggccacagtcacgggagggatctttttattcttgatgagcgggaggggcatagggaagatgaccctaggaatgtgctgcatagtcacggctagcatccttctatggtacgcacaaatacagccacactggatagcagcttcaataatactggagttttttctcatagttttgctcattccagaaccagaaaaacagagaacaccccaagacaaccaattgacctatgttgtcatagccatcctcacagtggtggccgcaaccatggcaaacgagatgggtttcctagaaaagacgaagaaagatcttggattaggaagcattgcaacccagcagcccgagagcaacatcctggacatagatctgcgccccgcatcagcatggacgctgtatgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagctccccttctcgccattggatgctactcacaagtcaatcccataactctcacagcagctcttctcttattggtagcgcattatgccattatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcccatctccacactgtgggaaggaaatccaggaaggttctggaacactaccattgcggtgtcaatggctaacatctttagagggagttacttggctggagctggacttctcttttccattatgaagaacacaaccaactcaagaaggggaactggcaacataggagagacgcttggagagaaatggaaaagccgattgaacgcactgggaaaaagtgaattccagatctacaagaaaagtggaatccaggaggtggatagaaccttagcaaaagaaggcattaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgccttcaaagtggagttgacgttttcttcatcccgccagaaaagtgtgacacattgttgtgtgacataggggagtcatcaccaaatcctacagtggaagcaggacgaacactcagagtccttaatttggtagaaaattggttgaacaacaacactcaattttgcataaaagttcttaacccatacatgccctcagttatagaaaaaatggaaacactgcaaaggaaatatggaggagccttagtgagaaatccactctcacggaactccacacatgagatgtactgggtttccaatgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaatctagacataattgggaaaagaatagaaaaaataaagcaagagcatgaaacatcatggcactacgaccaagaccacccatacaaaacatgggcataccatggcagctatgaaacaaaacagactggatcagcatcatccatggtcaatggagtggtcaggctgttgacaaaaccttgggacgtcctccccaccgtgacacagatggcaatgacagacacgactccatttggacaacagcgtgtttttaaagaaaaagtggacacgagaactcaagaaccgaaagaaggcacgaagaaactaatgaaaatcacagcagagtggctgtggaaggaattagggaagaaaaagacacctaggatgtgcaccagagaagaatttacaagaaaggtgagaagcaatgcagccttgggggccatattcactgatgagaacaagtggaagtcggcacgtgaggctgttgaagatagcaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaggctaggttacattctgagagacgtgagcaagaaagagggaggagccatgtatgccgatgacacagcaggatgggacacaagaattacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtgggcaagttggtacctatggactcaacactttcaccaatatggaagcccaattaatcagacagatggagggagaaggagtttttaaaaacattcagcacctgacagtcacagaagaaaccgccgtgcagaactggttagcaagagtggggcgcgaaaggttatcaagaatggccatcagtggagatgattgtgttgtgaaacctttagatgacaggttcgcgagcgctttgacagctctaaatgacatgggaaagattagaaaagacatacaacaatgggaaccttcaagaggatggaacgattggacacaagtgcccttctgttcacaccatttccatgaactaatcatgaaggatggtcgtgtacttgttgttccatgcagaaaccaagatgaactgattggcagagcccgaatctcccaaggagcagggtggtccttgcgggagacggcctgtttggggaagtcttacgcccaaatgtggagcttgatgtatttccacagacgcgacctcaggttagcggcaaatgccatttgctcggcagtgccatcacattgggttccaacaagtcgaacaacctggtccatacacgccaaacatgaatggatgacaacggaagacatgctgacagtctggaatagggtgtggattcaagaaaacccatggatggaagacaaaaccccagtagaatcatgggaggaaatcccgtacttggggaaaagagaagatcaatggtgcggctcattgattgggttaacaagcagggccacatgggcaaagaacatccaagtagcaataaatcaagttagatctcttataggcaatgaggaatacacagactacatgccatccatgaaaagattcagaagagaagaggaagaagcaggagtcctgtggtag

SEQ ID NO: 6711 - RNA, 9876 nt, synthetic construct
  misc_feature 1..9876: note = derived and/or modified CDS sequence (wt) from DENV-2__FJ744724__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatagtagacagagggtggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccgtcacagaagcagaattgacaggttatggcaccgtcacgatggagtgctctccgagaacaggcctcgatttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatctctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggcaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaagcttctttcattgaagtaaaaaactgccactggccaaagtcacacaccctctggagtaatggagtgctagaaagcgagatgataattccaaagaatctcgctggaccagtgtctcaacacaactatagaccaggctaccatacacaaatagcaggaccatggcatctaggtaagcttgagatggactttgacttctgcgatggaaccacagtggtagtgactgaggactgcggaaatagaggaccctctttaagaacaactactgcttctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcagattgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctaccatggcggatgacataggtatgggcgtgacttatcttgccctactagcagctttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtccttaaaatagtaagagacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtgatacaacttagtaggaagacttttgattctgagtatgtcaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacctatgccagtgacccactctagtgcagcgcaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagatctacgtcccgcatcagcatggacgctgtatgccgtggctacaacattcgttacaccaatgctgagacatagcattgagaattcctcagtgaatgtatccctaacagccatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccattatagggccaggacttcaagcaaaagcaaccagagaagctcagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgctgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagatttacaatgagacacaagaaagccacttacgagccggatgttgacctcggaagcggaacccgtaacattggaattgaaagtgaagtaccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagcccgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgggaaaacccatggatggaagacaaaaccccagtggaatcatgggaggaaatcccatacttggggaaaagagaagatcaatggtgtggctcactgattgggttaacaagcagggccacatgggcaaagaacattcaaacagcaataaatcaagttagatctcttataggcaatgaggaatacacagattacatgccatccatgaaaagattcagaagagaagaggaagaagcaggagtcctgtggtag

SEQ ID NO: 6712 - RNA, 9876 nt, synthetic construct
  misc_feature 1..9876: note = derived and/or modified CDS sequence (wt) from DENV-2__FJ906957__SS-prME
  source 1..9876: mol_type = other RNA
tctgcaggcatgatcattatgctgattccaacagtgatggcgttccatctaaccacacgtaacggagaaccacacatgatcgtcagtatacaggagaaagggaaaagtcttctgtttaaaacagaggatggcgtgaacatgtgcaccctcatggctatggaccttggtgaattgtgtgaagacacaatcacgtacaagtgccctcttctcaggcagaatgagccagaagacatagactgttggtgcaactccacgtccacgtgggtaacctatgggacttgtaccactacgggagaacatagaagagaaaaaagatcagtggcactcgttccacatgtgggaatgggactggagacgcgaaccgaaacatggatgtcatcagaaggggcttggaaacacgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggataaacaagggtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtctctagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctacggcctcagcccaccgagctaaagtattcatggaaaacatggggtaaagcaaaaatgctctccacagagtctcataaccaaacctttctcattgatggccccgaaacggcagagtgccccaacacaaatagagcttggaattcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaattagaccattgaaagagaaagaagaaaatttggttaactccttggtcacagccggacatgggcaggttgacaatttttcactgggagtcttgggaatggcattgttcctggaggaaatgcttaggacccgagtcggaacgaaacatgcaatactactagttgcagcttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactactcttgagaaagctgacctccaaggaattgatgatgactaccataggaattgtactcctttcccaaagcactataccagagaccattcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaaggagctggccactaaatgaggctatcatggcagtcggaatggtgagcattttagccagttccctcctaaaaaatgatattcccatgacaggaccactggtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttataaagaaggaacattccatacaatgtggcatgtcacacgtggcgctgtcctaatgcataaaggaaagaggattgaaccttcatgggcggacgtcaaaaaagatctaatatcatatggaggaggctggaagttagaaggagaatggaaggaaggagaagaagtccaggtgctggcactggagcccggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattgaagacaatccagagatcgaagatgacattttccgaaagagaagactgaccatcatggacctccacccaggagcgggaaagacaaaaagataccttccggccatagtcagagaagctataaaacggggtttgagaacattaatcttggcccctactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaactcgagtggagatgggtgaggcagctgggattttcatgacagccactcccccgggaagtagagatccatttccccagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggtcatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacattaacacaccagaaggaatcattcccagtatgtttgaaccagagcgtgaaaaagtggatgccattgatggcgaataccgcttgagaggagaagcaaggaaaacctttgtggacttaatgaggagaggagacctaccagtctggttggcctacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctattctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgctcttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaagacgaagaaagatcttggattaggaagcattgcaacccagcaacccgagagcaacatcctggacatagatctacgtcccgcatcagcttggacgctgtatgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggcatcatgaaaaacccaaccgtcgatggaataacagtgattgatctagatccaataccttatgatccaaagtttgaaaagcagctgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgttttcttcatcccgccagaaaagtgtgacacattgttgtgtgacataggggagtcatcaccaaaccccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttccgggaacatagtgtcatcagtgaacatgatttcaaggatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaatggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaagctaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaggagggaggagccatgtacgccgatgacacagcaggatgggacaccagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaaattgccgtgcaaaactggttggcaagagtggggcgcgaaaggttatcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 6713 - RNA, 9876 nt, synthetic construct
  misc_feature 1..9876: note = derived and/or modified CDS sequence (wt) from DENV-2__FJ906958__SS-prME
  source 1..9876: mol_type = other RNA
tctgtaggcatgatcattatgctgattccaacagtaatggcgttccatctgaccacacgcaacggagaaccacatatgatcgtcagtatacaagagaaagggaaaagtctcctgtttaaaacagaggatggcgtgaacatgtgcaccctcatggccatggaccttggtgaattgtgtgaagacacaatcacgtacaagtgtccccttctcagacagaatgagccagaagacatagattgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcttgctgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcaccttcaaaaatccccatgcgaagaaacaggatgttgttgttttaggatcccaagaaggggccatgcatacagcactcacaggagccacggaaatccaaatgtcgtcaggaaacttactcttcactggacatctcaagtgcaggctgagaatggacaagctacagctcaaaggaatgtcatactctatgtgcacaggaaagtttaaagttgtgaaggaaatagcagaaacacaacatggaacaatagtcatcagagtgcaatatgaaggggacggctctccatgtaaagtcccttttgagataatggatttggaaaaaagatatgtcttaggccgcctgatcacagtcaacccagttgtgacagaaaaagatagcccagtcaacatagaagcagaacctccattcggagacagctacatcatcataggagtagagccgggacaactgaagctcaactggttcaagaaaggaagttctatcggccagatgtttgagacaacaatgaggggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtgttggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagactggagaacctaatgtggaaacagataacaccagaattgaatcacattctagcagaaaatgaggtgaagttaactattatgacaggagacatcaaaggaatcatgcaggcaggaaaacgatctctgcggcctcagcccactgagctaaagtactcatggaaaacatggggcaaagcaaaaatgctctccacagagtctcataaccaaacttttctcattgatggccccgaaacagcagaatgccccaacacaaatagagcttggaactcattggaggttgaagactacggttttggagtgttcaccaccaatatatggctaaaattgaaagaaaaacaggatgcattctgcgactcaaaactcatgtcagcggccgtaaaagacaacagagccgtccatgccgacatgggttattggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtggtgactgaggactgcggaaatagaggaccctctttgagaacaactactgcctctggaaaactcataacagaatggtgctgccgatcttgcacattgccacccctaagatatagaggtgaggatgggtgctggtacgggatggaaatcagaccattgaaagagaaagaagaaaatttggttaactccttggtcacagccggacaagggcaggttgacaatttttcactaggagtcttgggaatggcattgttcctggaggaaatgcttaggacccgagtaggaacgaaacatgcaatactactagttgcagtttcttttgtgacattgatcacagggaacatgtcctttaaagacctaggaagagtggtggttatggtaggggccaccatgacggatgacataggtatgggcgtaacttatcttgccctactagcagcctttaaagtcagaccaacttttgcagctggactactcttgagaaagctgacctccaaggaattgatgatgaccaccataggaattgtactcctctctcaaagcactataccagaaaccatccttgaattgactgatgcgttagccttaggcatgatggtcctcaaaatagtaagagacatggaaaagtatcaattggcagtgactatcatggctatcttgtgcgtcccaaacgcagtgatattacaaaatgcatggaaagtgagttgcacaatactagcagtggtgtccgtttccccactgcttttgacatcctcacagcaaaaaacggattggataccattagcattgacaatcaagggtctcaatccaacagccatctttctaacaactctctcaagaaccaacaagaaaaggagctggccactaaatgaggccatcatggcagtcggaatggtgagcattttagccagttctctcctaaaaaatgatatccctatgacaggaccactagtggctggagggctcctcactgtatgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtactgtgggatgttccttcacccccacccatgggaaaggctgaactggaagatggagcctacagaatcaagcaaaaagggattcttggatattcccagatcggagctggagtttataaagaaggaacattccatacgatgtggcatgtcacacgtggcgctgtcctaatgcataaaggaaagaggattgaaccatcatgggcggacgtcaaaaaagatctaatatcatatggaggaggctggaagctagaaggagaatggaaggaaggagaagaagtccaggtgctggcattggagcctgggaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggcaatggtgttgttacaaggagtggagcatatgtgagtgctatagcccaaactgaaaaaagcattgaagacaacccagacatcgaagatgacattttccgaaagagaagactgaccatcatggacctccacccaggagcgggaaagacgaaaagataccttccggccatagtcagagaagccataaaacggggtttgagaacattaatcttggcccccaccagagttgtggcagctgaaatggaggaggctctcagaggacttccaataagataccaaaccccagccatcagagctgagcacacagggcgggaaattgtggatctaatgtgtcatgccacatttaccatgaggctgctatcaccagttagagtgccaaactacaacctgattatcatggatgaagcccatttcacagacccagcaagtatagcagctagaggatacatctcaactcgagtggagatgggtgaagcagctgggattttcatgacagccactcccccgggaagcagagatccatttcctcagagcaatgcaccgatcatagatgaagaaagagaaatccctgaacgttcatggaattctggacacgagtgggttacggattttaaagggaaaactgtttggttcgttccaagcataaaagcaggaaatgatatagcagcttgcctgagaaaaaatggaaagaaagtaatacaacttagtaggaagacttttgattctgagtatgccaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacattaacacaccagaaggaatcattcccagtatgtttgaaccagagcgtgaaaaagtggatgccattgatggcgaataccgcttgagaggagaggcaaggaaaacctttgtggacttaatgagaagaggagacctaccagtctggctggcctacaaagtggcagctgaaggcatcaactatgcagacagaaggtggtgttttgatggaatcaagaacaaccaaatcctggaagagaatgtggaagttgaaatttggacaaaagaaggggaaaggaagaaattgaaacccagatggctggatgctaggatctactctgacccactggcgctaaaagaattcaaagaatttgcagccggaagaaagtctctgaccctgaacctaattacagaaatgggtaggcttccaacattcatgactcagaagacaagagacgcactggacaacttagcagtgctgcatacggccgaagcaggtggaagggcgtacaatcatgctctcagtgaactgccggagaccctggagacactgcttttactgacacttctggctacagtcacgggagggatctttttattcttgatgagcgggaggggcatagggaagatgaccctgggaatgtgctgcatagtcacggctagcatccttttatggtacgcacaaatacagccacactggatagcagcttcaataatactggagttttttctcatagttttgcttattccagaaccagaaaaacagagaacaccccaagacaaccaattaacctatgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgccccgcatcagcatggacgctgtatgccgtggctacaacatttgttacaccaatgctgagacatagtattgagaattcctcagtgaatgtatccctaacagctatagctaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccattatagggccaggacttcaagcaaaagcaaccagagaagctcagaaaagagcagcggcgggcatcatgaaaaacccaaccgttgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttggctaccgggcccatctccacactgtgggaaggaaatccaggaaggttctggaacactaccattgcggtgtcaatggccaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgtcttcaaagtggagttgacgttttcttcatcccgccagaaaagtgtgacacattgttgtgtgacataggggagtcatcaccaaatcctacagtggaagcaggacgaacactcagagtccttaatttagtagaaaattggttgaacaacaacactcaattttgcataaaagttctcaacccatatatgccctcagttatagaaaaaatggaaacactgcaaaggaaatatggaggagccttagtgagaaatccactctcacggaactccacacatgagatgtactgggtatccaatgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaatctagacataattgggaaaagaatagaaaaaataaagcaagagcatgaaacatcatggcactacgaccaagaccacccatacaaaacgtgggcataccatggcagctatgaaacaaaacagactggatcagcatcatccatggtcaacggagtggtcaggctgctgacgaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagcaggttttgggagctggttgacaaggaaaggaatctccatcttgaaggaaagtgtgaaacatgtgtgtacaacatgatgggaaaaagagaaaagaagctaggggaattcggtaaggcaaaaggcagcagagccatatggtacatgtggctcggagctcgcttcctggagtttgaagccctaggattcctaaatgaagatcactggttctccagagagaactccttgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagagattagccgaggccattttcaaactaacgtaccaaaacaaggtggtgcgtgtgcaaagaccaacaccaagaggcacagtaatggacatcatatcaagaagagaccaaagaggtagtgggcaagttggtacctatggactcaatactttcaccaatatggaagcccaattaatcagacagatggagggagaaggagtttttaaaaacattcagcacctgacagtcacagaagaaatcgccgtgcagaactggttagcgagagtggggcgcgaaaggttatcaagaatggccatcagtggagatgattgtgttgtgaaacctttagatgacaggttcgcgagcgctttgacagctctaaatgacatgggaaagattagaaaagacatacaacaatgggaaccttcaagaggatggaacgattggacacaagtgcccttctgttcacaccatttccatgagctaatcatgaaggacggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggttggcggcaaatgccatttgctcggcagtgccatcacattgggttccaacaagtcgaacaacctggtccatacacgccaaacatgaatggatgacaacggaagacatgctgacagtctggaatagggtgtggattcaagaaaacccatggatggaagacaaaaccccagtggaatcatgggaggaaatcccgtacttggggaaaagagaagaccaatggtgtggctcactgattgggttgacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 6714 - RNA, 9876 nt, synthetic construct
  misc_feature 1..9876: note = derived and/or modified CDS sequence (wt) from DENV-2__FJ898452__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtaggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaattgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacggagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaggctctcagaggacttccaataagataccaaaccccagccattagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagccgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtctgagaggagaagcaaggaaaacctttgtggacttgatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaactttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccatatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggctacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6715 - RNA, 9876 nt, synthetic construct
  misc_feature 1..9876: note = derived and/or modified CDS sequence (wt) from DENV-2__GQ868591__SS-prME
  source 1..9876: mol_type = other RNA
tctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagagggcatttgtggaatccgttcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgctcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgagcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgttcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcggaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcgctgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtag

SEQ ID NO: 6716 - RNA, 9876 nt, synthetic construct
  misc_feature 1..9876: note = derived and/or modified CDS sequence (wt) from DENV-2__GQ868542__SS-prME
  source 1..9876: mol_type = other RNA
tctgcaggcatgatcattatgctgattccaacagtgatggcgttccatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcgtcagaaggggcttggaaacatgcccagagaattgaaacttggatcctgagacatccaggcttcaccataatggcagcaatcttggcatacaccatagggacgacacatttccagagagccctgattttcatcctactgacagctgtcgctccttcaatgacaatgcgttgtataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtaacctgtgctatgttcacatgcaaaaagaacatggaagggaaaatcgtgcaaccagaaaacttggaatacaccattgtggtaacacctcactcaggggaagagcatgcagttggaaatgacacaggaaaacatggcaaggaaatcaaagtaacaccacagagttccattacagaagcagaattgacaggttatggcaccgtcacgatggagtgctctccgaggacaggcctcgactttaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgaggatggacaagctacagctcaaaggaatgtcatactctatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtgacagaaaaagatagcccagttaacatagaagcagaacctccattcggagacagctacatcatcataggagtagagccgggacaactgaagctcaactggttcaagaaaggaagttctatcggccaaatgtttgagacaacaatgaggggggcgaagagaatggccattttgggtgacacagcctgggatttcggatccctgggaggagtgttcacatctataggaaaagctctccaccaagtctttggagcaatctatggagctgccttcagtggggtttcatggacaatgaaaatcctcataggagtcattatcacatggataggaatgaactcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcattacagacaacgtgcacacatggacagaacaatacaagttccaaccagaatccccttcaaaactagcttcagctatccagaaagctcaagaagagggaatttgtgggatccgctcagtaacaagattggaaaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccctgaaacggcagaatgccccaacacaaatagagcttggaactcgttggaggttgaagactacggctttggagtgttcaccaccaatatatggctaaaattgaaagaaaaacaggatgcattctgcgactcaaaacttatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaattatagaccaggctaccatacacaaatagcaggaccatggcatctaggtaagcttgaaatggactttgatttctgcgatggaaccacagtggtagtgactgaggactgtggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggtcatggtaggcgccaccatgacggatgacataggtatgggcgtgacttaccttgccctactagcagccttcaaagttagaccaacttttgcagctggactactcttgagaaagctgacctccaaggaattgatgatgaccaccataggaatcgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaaggagctggccactaaatgaggctatcatggcagtcggaatggtgagcattttagccagttctctcctaaaaaatgatattcccatgacaggaccactagtggctggagggctcctcactgtgtgctacgtgctcactggacgatcggccgacttggaactggagagagcaaccgacgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggggtattgtgggacgttccttcacccccacccatgggaaaggctgaactggaagatggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaggttgtgggtctttatggtaatggtgttgttacaaggagtggagcatatgtgagtgctatagcccaaactgaaaaaagcattgaagacaacccagagatcgaagatgacattttccgaaagagaagactgaccatcatggacctccacccaggagcgggaaagacgaaaagataccttccggccatagtcagagaagctataaaacggggtttgagaacattaatcttggctcccaccagagttgtggcagctgaaatggaggaagctctcagaggactcccaataagataccaaaccccagccatcagagctgagcacactgggcgggaaattgtggatctaatgtgtcatgccacatttactatgaggctgctatcaccagttagagtgccaaactacaacctgattatcatggacgaagcccatttcacagacccagcaagtatagcagctagagggtacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagactttcgattctgagtatgtcaagactagaaccaatgattgggatttcgtggttacaactgacatttcagaaatgggtgccaatttcaaagctgagagggttatagaccccagacgatgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggggaacctctggaaaatgatgaggactgtgcacactggaaagaagccaaaatgctcctagataacatcaacacaccagaaggaatcattcccagtatgtttgaaccagagcgtgaaaaagtggatgccattgatggtgaataccgcttgagaggagaagcaaggaaaacctttgtggacttaatgagaagaggagacctaccagtctggttggcctacaaagtggcagctgaaggcatcaactatgcagacagaaggtggtgttttgatggaattaagaacaaccaaattctggaagaaaatgtggaagttgaaatctggacaaaggaaggggaaaggaagaaattgaaacccagatggctggatgctaggatctattctgacccactggcgctaaaagaattcaaagaattcgcagccggaaggaagtccctgaccctgaacctaatcacagaaatgggtaggcttccaacattcatgactcagaagacaagagacgcactggacaacttggcggtgctgcacacggctgaagcaggtggaagggcgtacaatcatgctctcagtgaactgccggagaccctggagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggcttcctagaaaaaacgaagaaagatcttggattaggaggcattgcaacccagcaacccgagagcaacatcctggacatagatctacgtcccgcatcagcatggacgctgtatgccgtggctacaacatttgtcacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggcatcatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggtaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgtcttcagagtggagttgacgttttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagtcctcaacccatatatgccctcagtcatagaaaaaatggaagcactgcaaaggaaatatggaggagccttagtgagaaatccactctcacggaactccacacatgagatgtactgggtatccaatgcttccgggaacatagtgtcatcagtgaacatgatttcaaggatgttgatcaacagattcacaatgagacacaagaaagccacttacgagccggacgttgacctcggaagcggaacccgtaacattggaattgaaagtgaggtaccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaaatcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagagggaggaaccatgtatgccgatgatacagcaggatgggacacaagaatcacactagaagacctaaaaaatgaagaaatggtaacaaaccacatggaaggagaacacaagaaattagccgaggccatttttaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtttttaaaaacattcagcacctgacagtcacagaagaaatcgccgtgcaaaactggttagcaagagtggggcgcgaaaggttatcaagaatggccatcagtggagatgattgtgttgtgaaacctctagatgacaggttcgcaagcgctttgacagctctaaatgacatgggaaagattagaaaagacatacaacaatgggaaccttcaagaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcagactggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggattcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 6717 - RNA, 9876 nt, synthetic construct
  misc_feature 1..9876: note = derived and/or modified CDS sequence (wt) from DENV-2__GQ868544__SS-prME
  source 1..9876: mol_type = other RNA
tctgtaggcatgatcattatgctgattccaacagtaatggcgttccatctgaccacacgcaacggagaaccacatatgatcgtcagtatacaagagaaagggaaaagtctcctgtttaaaacagaggatggcgtgaacatgtgcaccctcatggccatggaccttggtgaattgtgtgaagacacaatcacgtacaagtgtcccctcctcagacagaatgagccagaagacatagattgttggtgcaactccacgtccacgtgggtaacctatgggacttgtaccaccacgggagaacacagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcttgctgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacattccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttactcttcactggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgtaaagtcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggttcaagaaaggaagttctatcggccagatgtttgagacaacaatgaggggggcgaagagaatggccatattgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtgttggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagactggagaacctaatgtggaaacagataacaccagaattgaatcacattctagcagaaaatgaggtgaagttaactattatgacaggagacatcaaaggaatcatgcaggcaggaaaacgatctctgcggcctcagcccactgagctaaagtattcatggaaaacatggggcaaagcaaaaatgctctccacagagtctcataaccaaacttttctcattgatggccccgaaacagcagaatgccccaacacaaatagagcttggaactcattggaggttgaagactacggttttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaagcctctttcattgaagtaaaaaactgccactggccaaaatcacacaccctctggagcaatggagtgctagaaagtgagatgataattccaaagaatctcgccggaccagtgtctcaacacaactatagaccaggctaccatacacaaatagcaggaccatggcatctaggtaagcttgagatggactttgatttctgcgatggaactacagtggtggtgactgaggactgcggaaatagaggaccctctttgagaacaactactgcctctggaaaactcataacagaatggtgctgccgatcttgcacattaccacccctaagatatagaggtgaggatgggtgctggtacgggatggaaatcagaccattgaaagagaaagaagaaaatttggttaactccttggtcacagccggacaagggcagattgacaatttttcactaggagtcttgggaatggcattgttcctggaggaaatgcttaggacccgagtaggaacgaaacatgcaatactactagttgcagtttcttttgtgacattgatcacagggaacatgtcctttaaagacctaggaagagtggtggttatggtaggggccaccatgacggatgacataggtatgggcgtaacttatcttgccctactagcagcctttaaagtcagaccaacttttgcagctggactactcttgagaaagctgacctccaaggaattgatgatgaccaccataggaattgtactcctctcccaaagcactataccagaaaccatccttgaattgactgatgcgttagccttaggcatgatggtcctcaaaatagtaagagacatggaaaagtatcaattggcagtgactatcatggctatcttgtgcgtcccaaacgcagtgatattacaaaatgcatggaaagtgagttgcacaatactagcagtggtgtccgtttccccactgcttttgacatcctcacagcaaaaaacggattggataccattagcattgacaatcaagggtctcaatccaacagccatctttctaacaactctctcaagaaccaacaagaaaaggagctggccactaaatgaggccatcatggcagtcggaatggtgagcattttagccagttctctcctaaaaaatgatatccccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatacttattagaacaggattgctggtgatctcaggactttttcctgtatcaataccaattacggcagcagcatggtacctgtgggaagtgaagaaacaacgggccggagtattgtgggatgttccttcacccccacccatgggaaaggctgaactggaagatggagcctacagaatcaagcaaaaagggattcttggatattcccagatcggagctggagtttataaagaaggaacattccatacgatgtggcatgtcacacgtggcgctgtcctaatgcataaaggaaagaggattgaaccatcatgggcggacgtcaaaaaagatctaatatcatatggaggaggctggaagctggaaggagaatggaaggaaggagaagaagtccaggtgctggcattggagcctgggaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggcaatggtgttgttacaaggagtggagcatatgtgagtgctatagcccaaactgaaaaaagcattgaagacaacccagacatcgaagatgacattttccgaaagagaagactgaccatcatggacctccacccaggagcgggaaagacgaaaagataccttccggccatagtcagagaagccataaaacggggtttgagaacattaatcttggcccccaccagagttgtggcagctgaaatggaggaagctctcagaggacttccaataagataccaaaccccagccattagagctgagcacacagggcgggaaattgtggatctaatgtgtcatgccacatttactatgaggctgctatcaccagttagagtgccaaactacaacctgattatcatggatgaagcccatttcacagacccagcaagtatagcagctagaggatacatctcaactcgagtggagatgggtgaagcagctgggattttcatgacagccactcccccgggaagcagagatccatttcctcagagcaatgcaccgatcatagatgaagaaagagaaatccctgaacgttcatggaattctggacacgagtgggttacggattttaaagggaaaactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacattaacacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggctggcctacaaagtggcagctgaaggcatcaactatgcagacagaaggtggtgttttgatggaatcaagaacaaccaaatcctggaagagaatgtggaagttgaaatctggacaaaagaaggggaaaggaagaaattgaaacccagatggctggatgctaggatctactctgacccactggcgctaaaagaattcaaagaatttgcagccggaagaaagtctctgaccctgaacctaattacagaaatgggtaggcttccaacattcatgacccagaagacaagagacgcactggacaacttagcagtgctgcacacggccgaagcaggtggaagggcgtacaatcatgctctcagtgaactgccggagaccctggagacactgcttttactgacacttctggctacagtcacgggagggatctttttattcttgatgagcgggaggggcatagggaagatgaccctgggaatgtgctgcatagtcacggctagcatccttttatggtacgcacaaatacagccacactggatagcagcctcaataatactggagttttttctcatagttttgcttattccagaaccagaaaaacagagaacaccccaagacaaccaactaacctatgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgccccgcatcagcatggacgttgtatgccgtggctacaacatttgttacaccaatgctgagacatagtattgagaattcctcagtgaatgtatccctaacagctatagctaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccattatagggccaggacttcaagcaaaagcaaccagagaagctcagaaaagagcagcggcgggcatcatgaaaaacccaaccgttgatggaataacagtgattgatctagatccaataccttatgatccaaagtttgaaaagcagttgggacaagtaatgctcctagtcctctgcgtgactcaagtattgatgatgagaactacatgggctctgtgtgaggccttaaccttagctaccgggcccatttccacactgtgggaaggaaatccaggaaggttctggaacactaccattgcggtatcaatggctaacatctttagagggagttacttggctggagctggacttctcttttccattatgaagaacacaaccaacacaagaaggggaactggcaatataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcaacatatgggtggaacctagtgcgtcttcaaagtggagttgacgttttcttcatcccgccagaaaagtgtgacacattgttgtgtgacataggggagtcatcaccaaatcctacagtggaagcaggacgaacactcagagtccttaatttagtagaaaattggttgaacaacaacactcaattttgcataaaagttctcaacccatatatgccctcagttatagaaaaaatggaaacactgcaaaggaaatatggaggagccttagtgagaaatccactctcacggaactccacacatgagatgtactgggtatccaatgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaatctagacataattgggaaaagaatagaaaaaataaagcaagagcatgaaacatcatggcactacgaccaagaccacccatacaaaacgtgggcataccatggcagctatgaaacaaaacagactggatcagcatcatccatggtcaacggagtggtcaggctgctgacaaaaccctgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagcaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggcttggagctcgcttcttggagtttgaagccctaggattcctaaatgaagatcactggttctccagagagaactccttgagtggagtggaaggagaagggctgtacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtaccaaaacaaggtggtgcgtgtgcaaagaccaacaccaagaggcacagtaatggacatcatatcaagaagagaccaaagaggtagtgggcaagttggtacctatggactcaatactttcaccaatatggaagcccaattaatcagacagatggagggagaaggagtttttaaaaacattcagcacctgacagtcacagaagaaatcgctgtgcagaactggttagcgagagtggggcgcgaaaggttatcaagaatggccatcagtggagatgattgtgttgtgaaacctttagatgacaggttcgcgagcgctttgacagctctaaatgacatgggaaagattagaaaagacatacaacaatgggaaccttcaagaggatggaacgattggacacaagtgcctttctgttcacaccatttccatgagctaatcatgaaggatggtcgtgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggttggcggcaaatgccatttgctcggcagtgccatcacattgggttccaacaagtcgaacaacctggtccatacacgccaaacatgaatggatgacaacggaagacatgctgacagtctggaatagggtgtggattcaagaaaacccatggatggaagacaaaaccccagtggaatcatgggaggaaatcccgtacttggggaaaagagaagaccaatggtgcggctcactgattgggttaacaagcagggccacatgggcaaagaacatccaagcagcaataaatcaagttagatctctcataggcaatgaggaatacacagattacatgccatccatgaaaagattcagaagagaagaggaagaagcaggagtcctgtggtag

SEQ ID NO: 6718 - RNA, 9876 nt, synthetic construct
  misc_feature 1..9876: note = derived and/or modified CDS sequence (wt) from DENV-2__GQ868545__SS-prME
  source 1..9876: mol_type = other RNA
tctgcaggcatgatcattatgctgattccaacagtaatggcgttccatctaaccacacgcaacggagaaccacacatgatcgtcagtatacaagagaaagggaaaagtcttctgtttaagactgaggatggcgtgaacatgtgcaccctcatggccatggaccttggtgaattgtgtgaagacacaatcacgtacaagtgtccccttctaaggcagaatgagccagaagacatagactgttggtgcaactccacgtccacgtgggtaacctatgggacttgtaccaccacgggagaacatagaagagaaaaaagatcagtggcacttgttccacatgtgggaatgggactggagacgcgaaccgaaacatggatgtcatcagaaggggcttggaaacatgcccagagaatcgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgtccaacacaaggggaacccagcctaaaagaagagcaggataagaggttcgtctgcaaacactccatagtagacagagggtggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtgacaccacagagttccgtcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggacacacaagggtcaaattggatacagaaagaaacattggtcactttcaaaaacccccatgcgaagaaacaggatgttgttgttttaggatcccaagaaggggccatgcatacagcactcacaggagccacagaaatccaaatgtcgtcaggaaacttactcttcactggacatctcaagtgcaggctgagaatggacaagctacagctcaaaggaatgtcatactccatgtgcacaggaaagttcaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtgacagaaaaagatagcccagttaacatagaagcagaacctccattcggagacagctacattatcataggagtagagccgggacaactgaagctcaactggttcaagaaaggaagttctatcggccaaatgtttgagacaacaatgaggggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtattggtaggaattgtgacactgtacttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtaaaattaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttcttattgatggccccgaaacagcagaatgccccaacacaaatagagcttggaactcgttggaggttgaagactacggttttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagaaaaagcctctttcattgaagtaaaaaactgccactggccaaagtcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttaagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcagattgacaatttttcactaggagtcttgggaatggcattgttcctggaggaaatgcttaggacccgagtaggaacgaaacatgcaatactactagttgcagtttcttttgtgacattgatcacagggaacatgtcctttaaagacctaggaagagtggtggttatggtgggcgccaccatgacggatgacataggtatgggcgtaacttatcttgccctactagcagccttcaaagtcagaccaactcttgcagctggactactcttgagaaaactgacctccaaggaattgatgatgactaccataggaattgtactcctctcccaaagcactataccagagaccattcttgaattgactgatgcgctagccttaggcatgatggtcctcaaaatagtaagagacatggaaaagtatcaattagcagtgactatcatggctaccttgtgcgtcccaaacgcagtgatattacaaaatgcatggaaagtgagttgcacaatactagcagtggtatccgtttccccactgcttttgacatcctcacagcaaaaaacggattggataccattagcattgacaatcaagggtctcaatccaacagccatttttctaacaaccctctcaagaaccaacaagaaaaggagctggccactaaatgaggctatcatggcagtcggaatggtgagcattttagccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctacagaatcaagcaaaaagggattcttgggtattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagctagaaggagaatggaaggaaggagaagaagtccaggtgctggcattggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattgaagacaacccagacatcgaagatgacattttccgaaagagaagactgaccatcatggacctccacccaggagcgggaaagacgaaaagatacctcccggccatagtcagagaagctataaaacggggtttgagaacattaatcttggcccccaccagagtcgtggcagctgaaatggaggaagctctcagaggacttccaataagataccaaaccccagccatcagagctgagcacacagggcgggaaattgtggatctaatgtgtcatgccacatttaccatgaggctgctatcaccagttagagtgccaaactacaacttgattatcatggatgaagcccatttcacagacccagcaagtatagcagctagaggatacatctcaactcgagtggagatgggtgaagcagctgggattttcatgacagccactcctccgggaagcagagatccatttcctcagagcaatgcaccaatcatagatgaagaaagagaaatccctgaacgttcatggaattctggacatgagtgggtcacggattttaaagggaagactgtctggttcgttccaagcataaaagcaggaaatgatatagcagcttgcctgagaaaaaatggaaagaaagtgatacaacttagtaggaagacttttgattctgagtatgtcaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacctatgccagtgacccactctagtgcagcgcaaagaagagggaggataggaagaaatccaaaaaatgaaaatgaccagtacatatacatgggggaacctctggaaaatgatgaagactgtgcacactggaaagaagccaaaatgctcctagataacattaacacaccagaaggaatcattcccagtatgtttgaaccagagcgtgaaaaggtggatgccattgatggcgaataccgcttgagaggagaagcaaggaaaacctttgtggacctaatgagaagaggagacctaccagtctggttggcctacaaagtggcagctgaaggcatcaactatgcagacagaaggtggtgttttgatggaatcaagaacaaccaaatcctggaagagaatgtagaagttgaaatctggacaaaagaaggggaaaggaagaaattgaaacccagatggctggatgctaggatctactctgacccactggcgctaaaagaattcaaagaatttgcagccggaagaaagtctctgaccctgaacctaatcacagaaatgggtaggcttccaacattcatgactcagaagactagagacgcactggacaacttagcagtgctgcacacggctgaggcaggtggaagggcgtacaatcatgctctcagtgaactgccggagaccctggagacactgcttttactgacacttctggctacagtcacgggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctatgttgtcatagccatcctcacagtggtggccgcaaccatggcaaacgagatgggtttcctagaaaaaacgaagaaagatcttggattaggaagcatcgcaacccagcaacccgagagcaacatcctggacatagatctacgccccgcatcagcatggacgctgtatgccgtggctacaacatttgttacaccaatgctgagacatagcattgagaattcctcagtgaacgtatccctaacagccatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccattatagggccaggacttcaagcaaaagcaaccagagaagctcagaaaagagcagcggcgggcatcatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctgacaaaaggaggaccaggacacgaagaacccatccccatgtcaacatatgggtggaatctagtgcgtcttcaaagtggagttgacgttttcttcatcccgcccgaaaagtgtgacacattgctgtgtgacataggggagtcatcaccaaatcctacagtggaagcaggacgaacactcagagtccttaatttagtagaaaattggttgaacaacaacactcaattttgtataaaagtcctcaacccatatatgccctcagttatagaaaaaatggaaacactgcaaaggaaatatggaggagccttagtgagaaatccactctcacggaactccacacatgagatgtactgggtatccaacgcttccgggaacatagtgtcatcagtgaacatgatttcaaggatgttgatcaacagatttacaatgagacacaagaaagccacttacgagccggatgttgacctcggaagcggaacccgtaacattggaattgaaagtgagataccaaatctagacataattgggaaaagaatagaaaaaataaagcaagagcatgaaacatcatggcactacgaccaagaccacccatacaaaacgtgggcataccatggcagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaagctccatcttgaaggaaagtgtgaaacatgtgtgtacaacatgatgggaaaaagagaaaagaagctaggggaattcggcaaggcaaaaggcagcagagccatatggtacatgtggcttggagctcgctttctggagtttgaagccctaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattgatcagacagatggagggagaaggagtttttaaaaacattcagcacctgacagtcacagaagaaattgccgtgcaaaactggttagcaagagtgggacgcgaaaggttatcaagaatggccatcagtggagatgattgtgttgtgaaacctttagatgacaggttcgcaagcgctttgacagctctaaatgacatgggaaagattagaaaagacatacaacaatgggaaccttcaagaggatggaacgattggacacaagtgcccttctgctcacaccatttccatgagctaatcatgaaggatggtcgtgtacttgttgttccatgcagaaaccaagatgaactgattggcagagcccgaatctcccaaggagcagggtggtctttgcgggagacggcttgtttggggaagtcttacgcccaaatgtggagcttgatgtatttccacagacgcgacctcaggttggcggcaaatgccatttgctcggcagtgccatcacattgggttccaacaagtcgaacaacctggtccatacacgccaaacatgaatggatgacaacggaagacatgctgacagtctggaatagggtgtggattcaggaaaacccatggatggaagacaaaaccccagtagaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 6719 - RNA, 9876 nt, synthetic construct
  misc_feature 1..9876: note = derived and/or modified CDS sequence (wt) from DENV-2__GQ868543__SS-prME
  source 1..9876: mol_type = other RNA
tctgcaggcatgatcattatgctgattccaacagtgatggcgttccatctaaccacacgtaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacttgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacgatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaagaaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggataaacaagggtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggaatgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccccgaaacggcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtggtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcattgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccattcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaaggagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccggccatagtcagagaagctataaaacggggtttgagaacattaatcctggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcccagtatgtttgaaccagagcgtgaaaaagtggatgccattgatggcgaataccgcttgagaggagaagcaaggaaaacctttgtggacttaatgaggagaggagacctaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagactctagagacactgctcttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttcttgccattggatgctactcacaagtcaatcccataactctcacagcagctcttctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagttacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgttttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtacgccgatgacacagcaggatgggacacaagaatcacactagaagacctaaaaaatgaagaaatggtaacaaaccacatggaaggagaacacaagaaattagccgaggctattttcaaactaacgtatcaaaacaaggtggtgcgtgtgcaaagaccaacaccaagaggcacagtaatggacatcatatcgagaagagaccaaagaggtagtgggcaagttggcacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttatcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 6720 - RNA, 9876 nt, synthetic construct
  misc_feature 1..9876: note = derived and/or modified CDS sequence (wt) from DENV-2__EU482544__SS-prME
  source 1..9876: mol_type = other RNA
acagcaggcgtgattattatgttgattccaacagtaatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgccccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatataccataggaacgacacatttccaaagggctctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagatctgccgttaccatggctacccggagcggacacacaaggatcaaattggatacagaaagagacgttggtcactttcaaaaatccccacgcgaagaaacaggacgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtgcaatatgaaggggacggctctccatgtaagattccttttgagataatggatttggaaaaaagacacgtcctaggtcgcctgattacagtgaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttttccacaaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcgcacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgtgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctactatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggtttgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcttatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgccatagcccagaccgaaaaaagcattgaagacaatccagagatcgaagatgacattttccgaaagaaaagattgaccatcatggatctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagctcacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatcgggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacacagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgctgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcgtcagtgaacatgatttcaaggatgttgattaacagattcacaatgaagcacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagagatcgctgtgcagaactggttagcaagagtggggcgtgaaaggttatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttaggaaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6721 - RNA, 9876 nt, synthetic construct
  misc_feature 1..9876: note = derived and/or modified CDS sequence (wt) from DENV-2__EU482545__SS-prME
  source 1..9876: mol_type = other RNA
acagcaggcgtgattgttatgttgattccaacagcgatggcgtttcatttaaccacacgcaatggagaaccacacatgatcgttggtaggcaggagaaaggaaaaagtcttctgttcaaaacagaggatggtgtcaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccactacaggggaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagttgaccaacacaacaacagaatctcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtgcagccagaaaatttggaatacaccatcatgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtacacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcatacggcactcacaggggccacagaaatccagatgtcatcaggaaacttactgttcacaggacatctcaagtgcaggctgagaatggacaaactacagctcaaaggaatgtcatactctatgtgcacaggaaagtttaaaattgtgaaggaaatagcagaaacacaacatggaacaatagttatcagagtacaatatgaaggggatggttctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggattttggatccctgggaggagtgtttacatctgtaggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactatacctgggagctatggtgcaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctctgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagtcgaagactatggttttggagtttttaccaccaatatatggctaaaattgagagaaaaacaggatgtattttgtgactcaaaactcatgtcagcggccattaaagacaacagagccgtccatgctgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggcaagcttgagatggactttgatttctgcgaaggaactacagtggtggtgactgaggactgtggaaatagaggaccttctttaagaacgaccactgcctctggaaaactcataacagaatggtgctgccgatcctgtacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggtgctaccatgacggatgacataggtatgggagtgacttatcttgccctactagcagctttcaaagttagaccaacttttgcagctggactactcttgagaaaactgacctccaaggaattaatgatggccaccataggaatcgctctcctttcccaaagcaccataccagagaccattcttgaactgactgatgcgttagccttgggcatgatggctctcaaaatagtgaaaaatatggaaaagtaccaattggcagtgactatcatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacgactctttcgagaaccagcaagaaaaggagctggccgctaaatgaagctatcatggcagttgggatggtgagcattttagccagttctctcctgaagaatgatattcccatgacaggtccattagtggctggagggctccttacagtatgttacgtgctcactggacgatcggccgatttggaactagagagagcggccgatgtaaaatgggaagatcaggcagaaatatcaggaagcagcccaatcctgtcaataacaatatcagaagatggcagcatgtcgataagaaatgaagaggaagaacaaacactgaccatactcatcagaacgggattgttggtgatctcaggagtctttccagtatcgataccagttacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctagtatcatatggaggaggctggaagctagaaggagaatggaaggaaggagaggaagtccaagtcctggcattagaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagaaatcgaagatgacattttccgaaagaaaagattgaccatcatggaccttcatccaggagcaggaaagacaaaaagataccttccagccatagttagagaagccataaaacgtggcttgagaacattaatcctggctcccaccagagtcgtggcagctgaaatggaggaagctcttagaggacttccaataagataccaaaccccagccatcagagccgagcacaccgggcgagagatcgtggacctaatgtgtcatgccacatttactatgaggctgctatcaccagtcagagtgccaaattacaacctgatcatcatggacgaagcccacttcacagacccagcaagcatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggattttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgacgaagactgtgcacattggaaagaagccaaaatgctcctagataacatcaacacacccgaaggaatcattcctagtatgttcgaaccagagcgtgaaaaagtggatgccattgatggtgaataccgtttgagaggagaagcaaggaaaaccttcgtggacctaatgagaagaggggacttaccagtctggttagcctacaaagtggcagctgaaggcatcaactacgcagacagaaggtggtgttttgatggaatcaagaataaccaaatactggaagaaaatgtggaagtggaaatctggacaaaagaaggggaaaggaaaaaattaaaacccagatggttggatgctaggatctattctgacccactggcactaaaagaattcaaggaatttgcagccgggagaaaatctttgaccctgaatttaatcacagaaatgggtaggcttccaactttcatgactcagaaggcaagaaacgcactggacaacttggctgtgctgcatacggctgaggcaggtggaaaggcgtataatcatgctctcagtgaactgccggagaccctggagacactgcttctactaacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgtcctgcatcagcatggacgctgtatgccgtggccacaacatttgtcacaccaatgttgaggcatagcattgaaaattcctcagtgaatgtctccctaacagccattgctaaccaagctacagtgctaatgggtcttgggaaaggatggccattgtcaaagatggacatcggagttcccctcctcgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccttagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccctggcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacctatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaatccatatatgccctcagtcatagaaaaaatggaaacactacaaaggaaatatggaggagccttagtgaggaatccactctcacgaaactccacgcatgagatgtactgggtatctaatgccactgggaacatagtgtcatcagtgaacatgatttcaaggatgttgattaacagattcacaatgaaacacaagaaagccacctacgagccggatgttgacctgggaagtggaactcgcaacattggaattgaaagtgagataccaaatctagacataataggaaagagaatagagaaaataaagcaagagcatgaaacatcatggcactatgaccaagaccacccatacaaaacgtgggcttaccatggcagctatgagacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaacccaagaaccgaaggaaggcacaaagaaactgatgaaaattacggcagagtggctttggaaagaactaggaaagaaaaagacacccaggatgtgtaccagagaagaattcacaagaaaggtgagaagcaatgcagccttgggggccatattcactgatgagaacaaatggaaatcggcacgtgaggctgttgaagatggtaggttttgggagctggttgacagggaaagaaatctccatcttgaaggaaagtgtgagacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaagctagccgaggccatattcaaattaacgtaccaaaacaaagtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagtcacagaagaaatcgctgtacagaactggctagcaagagtggggcgtgaaaggctatcaagaatggccatcagtggagatgattgtgttgtaaaacccatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccaaggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacgagtcgaacaacctggtccatacacgctaagcatgaatggatgacgacggaggacatgctggcagtctggaacagggtgtggatccaagaaaacccgtggatggaagacaaaactccagtggaatcatgggaagaagtcccatacttggggaaaagagaagaccaatggtgtggctcattgattgggctaacaagcagggctacctgggcaaagaacatccaaacagcaataaaccaagtcagatcccttataggcaatgaggaatacacagactacatgccatccatgaagagattcagaagggaagaggaagaggcaggtgtcctgtggtag

SEQ ID NO: 6722 - RNA, 9876 nt, synthetic construct
  misc_feature 1..9876: note = derived and/or modified CDS sequence (wt) from DENV-2__EU482546__SS-prME
  source 1..9876: mol_type = other RNA
acagcaggcgtgattgttatgttgattccaacagtgatggcgttccatttaaccacacgcaatggagaaccacacatgatcgttggtaggcaggagaaagggaaaagtcttctgttcaaaacagaggatggtattaacatgtgtaccctcatggccatagaccttggtgaattgtgtgaagatacaatcacgtacaagtgtcctctcctcaaacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccatagggacgacacatttccaaagggccttgattttcatcttactgacagctgtcgctccttcaatgacaatgcgctgcataggaatatcaaatagagacttcgtagaaggggtctcaggaggaagctgggttgacatagtcttagaacatggaagttgtgtgacgacgatggcaaaaaacaaaccaacattggattttgaactgataaaaacagaagccaaacaacctgccactttaaggaagtactgtatagaagcaaagctgaccaacacaacaacagaatcgcgttgcccaacacaaggggaacccagtctaaatgaagagcaggacaaaaggttcatctgcaaacattccatggtagacagaggatggggaaatggatgtggattatttggaaagggaggcattgtgacctgtgctatgtttacatgcaaaaagaacatggaaggaaaagtcgtacagccagaaaatttggaatacaccatcgtgataacacctcactcaggagaagaacacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaagctacagctcaaaggaatgtcatactctatgtgtacaggaaaatttaaaattgtgaaggaaatagcagaaacacaacatggaacaatagttatcagagtacaatatgaaggagacggttctccatgtaagatcccttttgagataacagacttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggattttggatccctgggaggggtgtttacatctataggaaaggctctccaccaagtttttggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacggtccttgcggccccagcccactgagctgaagtactcttggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaggatgcattttgtgactcaaaactcatgtcagcggccattaaagacaacagagccgtccatgccgatatgggttattggatagaaagtgcactcaatgacacatggaagatggagaaagcctcattcattgaagttaaaagctgccactggccaaagtcacacaccctctggagcaatggagtattagaaagtgagatgataattccaaaaaattttgccgggccagtgtcacaacacaaccacagaccaggttaccacacacaaacagcaggaccttggcatctaggtaagcttgagatggactttgatttctgcgaaggaaccacagtggtggtgactgaggactgtggaaatagaggaccctctttaagaacgaccactgcctccggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggcatgggagtgacttatcttgccctactagcagctttcaaagttagaccaacttttgcagctggactactcttgagaaaactgacctccaaggaattaatgatggccaccataggaattgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctctcgagaaccagcaagaaaaggagctggccgctaaatgaagctatcatggcagtcgggatggtgagcattttagccagttctctcctaaagaatgatattcccatgacaggtccactagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggactgttggtgatctcaggagtctttccagtatcgataccaattacggcagcagcatggtacctgtgggaagtgaagaaacaacgggccggagtattgtgggacgtcccttcacccccaccagtgggaaaagccgaactggaagatggagcctatagaatcaagcaaagagggtttcttggatattctcagattggagccggagtttacaaagaaggaacattccatacaatgtggcacgtcacacgtggtgctgttcttatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacactggaaccataggcgccgtatctttggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggactttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggattttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagccaaaatgctcctagataacatcaacacacccgaaggaatcattcctagtatgtttgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaatgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacacagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttgttggtagcacattatgccattatagggccaggacttcaagcaaaagcaaccagagaagcacagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggccttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatttacaagaaaagtggaatccaggaagtggatagaaccctagcaaaagaaggcataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatccccatgtcaacatatgggtggaatctggtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacattgcaaaggaaatatggaggagccttggtgaggaatccactctcacgaaactccacgcatgaaatgtactgggtatctaatgccaccggtaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaacccaagaaccgaaggaaggcacaaagaaactgatgaaaattacggcagagtggctttggaaagaactaggaaagaaaaagacacctagggtgtgtaccagagaagaattcacaagaaaagtgagaagcaatgcagccttgggggccattttcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaaaaaggaagggggagcaatgtacgccgatgatacagcaggatgggacacaagaatcacactagaagatttaaagaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtggacaagtcggcacctatggccttaatacttttaccaatatggaagcccaattaattagacagatggagggagaaggaatcttcaaaagcattcagcacctgacagccacagaagaaatcgctgtacagaactggttagcaagagtggggcgtgaaaggctatcaagaatggccatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttagggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataagtcaagtcagatctcttataggcaatgaggaatacacagactacatgccatccatgaagagattcagaagggaagaggaagaggcaggtgtcctgtggtag

SEQ ID NO: 6723 - RNA, 9876 nt, synthetic construct
  misc_feature 1..9876: note = derived and/or modified CDS sequence (wt) from DENV-2__EU482550__SS-prME
  source 1..9876: mol_type = other RNA
acagcaggcgtgattattatgttgattccaacagcaatggcattccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgtccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagatacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatctctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacaactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgataacttttcactaggagtcttgggaatggctctgttcctggaagaaatgctcaggacccgagtaggaacgaaacatgcaatactgctagtggcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggattactcttgagaaaactgacctccaaggaactaatgatggccaccataggaatcgcactcctttcccaaagcaccataccagagactattcttgaactgactgatgcgttagccttgggcatgatggtcctcaaaatagtgagaaatatggaaaagtaccaattggcagtgactatcatggctatcttgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggaggacttcttaccgtgtgttacgtgctcactggacgatcggccgatttggaactggagagagctgccgatgtaaaatgggaagatcaggcagaaatatcaggaagcagtccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgtcctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacgtttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccagttgacctacgtagtcatagccatcctcacagtggtggccgcaaccatggcaaatgagatgggtttcctggaaaaaaccaagaaagacctcggactgggaagcattataacccaggaatctgagagcaacatcctggacatagatttacgtcctgcatcagcatggacgctgtatgccgtggccacaacatttgttacaccaatgttgagacatagcatcgaaaattcctcagtgaatgtctccctaacagccattgctaaccaggccacagtgctaatgggtcttgggagaggatggccattgtcaaagatggacatcggagttcccctccttgccattggatgctattcacaagtcaaccctataactctcacagcagcccttcttttgctggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgacccaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggaccttggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctgggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactaatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcggacaagtcggcacctatggccttaatactttcaccaacatggaagcccaattaattagacagatggagggagaaggaatttttaaaagcattcagcacctgacagtcacagaagaaatcgctgtacagaactggctagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaagccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccatggatggaagacaaaactctagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6724 - RNA, 9876 nt, synthetic construct
  misc_feature 1..9876: note = derived and/or modified CDS sequence (wt) from DENV-2__EU482551__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggggttaacatgtgcaccctcatggccatagaccttggtgaattgtgtgaagatacaatcacgtacaagtgtcccctcctcaggcaaaatgaaccagaagacatagattgttggtgcaactccacgtccacatgggtaacttatggaacatgtaccaccacaggagaacacagaagggaaaaaagatcagtggcactcgttccacatgtgggcatgggactggagacacgaactgaaacatggatgtcatcagaaggggcctggaaacacgttcagagaattgaaacctggatcttgagacatccaggctttaccacaatggcagcaatcctggcatacaccataggaacgacacatttccaaagggtcctgatcttcattttactgacagccgtcgctccttcaatgacaatgcgttgcataggaatatcaaatagagacttcgtagaaggggtttcaggaggaagttgggtcgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaagggggcattgtaacctgtgctatgttcacatgcaaaaagaacatggaaggaaaagttgtgctgccagaaaatctggaatacaccatcgtgataacacctcactcaggagaagagcacgctgtaggcaatgatacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaactggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgatcacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggccctccaccaagttttcggagcaatctatggggctgcttttagtggggtctcatggactatgaaaatcctcataggagttatcatcacatggataggaatgaattcacgtagcacctcactgtctgtgtcactagtattggtgggaatcgtgacactgtacttgggggttatggtgcaggctgacactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcactggaagttgaagactatggttttggagttttttctaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcgtggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagttggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagaaagctgccgatgtaaaatgggaagatcaggcagaaatatcaggaagtagcccaatcctgtcaataacaatatcagaagatggcagcatgtcgataaaaaatgaagaggaagaacatacactgaccatactaatcagaacgggattactggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagctaatgattgggattttgtggtcacaactgacatttcagaaatgggtgccaacttcagggctgagagggttatagaccccagacgttgcatgaaaccagttatactaacagatggcgaagagcgggtcatcttggcaggacctatgccagtgacccactccagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgctttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagtaacattctggacatagatctacgtcctgcatcagcatggacgctgtatgccgtggccacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctggtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaactttagcaaaagaaggcatcaaaagaggggaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaaccccacgatagaagcaggacgaacacttagagtcctcaacttagtggaaaattggttgaacaataacactcaattttgcgtaaaggttctcaacccatacatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagctacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagccttgggggccatattcactgatgagaacaaatggaaatcggctcgtgaggctgttgaagatagtaggttttgggaactggttgacagggaaagaaatcttcatcttgaaggaaagtgtgaaacatgtgtgtacaacatgatggggaaaagagagaagaaactaggggagttcggcaaggcaaaaggtagcagagccatatggtatatgtggcttggagcacgtttcttagagtttgaagccctaggattcttgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtatcaaaacaaggtggtgcgtgtacaaagaccaacaccaagaggcacagtaatggacatcatatcgagaaaagaccaaagaggcagcgggcaagtcggcacctatggccttaatacttttaccaacatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcatgctcgtggttccatgcagaaaccaagatgaactgattggcagagcccgaatttctcagggagccgggtggtctttgaaggagacggcctgtttggggaagtcttacgcccaaatgtggaccttgatgtacttccacagacgtgacctcagactggcggcgaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6725 - RNA, 9876 nt, synthetic construct
  misc_feature 1..9876: note = derived and/or modified CDS sequence (wt) from DENV-2__EU482552__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattctactgacagccgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacactatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctacaggaaaggctctccaccaagttttcggagcaatctatggggcagcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgcggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgcgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccctggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggatatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaattgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctatcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaattaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgttcaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtggagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggactttaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctttggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactaccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagttttttctcatagttttgctcattccagaaccagaaaaacagagaacaccccaagacaaccaattgacctacgtagtcatagccatcctcacagtggtggctgcaaccatggcaaatgagatgggcttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggaagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatctccatcttgaggggaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaaggccaacaccaagaggcacagtaatggatatcatatcgagaaaagaccaaagaggcagcgggcaagtcggcacctatggcctcaatactttcaccaatatggaagcccaattaattagacagatggaaggagaaggaattttcaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagccagaatttcccagggagccgggtggtctttgaaggagacggcctgtttggggaagtcttacgcccaaatgtggaccttgatgtacttccacagacgtgacctcagactagcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6726 - RNA, 9876 nt, synthetic construct
  misc_feature 1..9876: note = derived and/or modified CDS sequence (wt) from DENV-2__EU482554__SS-prME
  source 1..9876: mol_type = other RNA
acagcaggcgtgattattatgttgattccaacagcaatggcattccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgtccaacacaaggggagcccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaacagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcacttacaggggccactgaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagatacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatctctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaacaaagaactgaaatgtggcagcgggatcttcattacagataacgtgcacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacaactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggattactcttgagaaaactgacctccaaggaactaatgatggccaccataggaatcgcactcctttcccaaagcaccataccagagactattcttgaactgactgatgcgttagccttgggcatgatggtcctcaaaatagtgagaaatatggaaaagtaccaattggcagtgactatcatggctatcttgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggaggacttcttactgtgtgttacgtgctcactggacgatcggccgatttggaactggagagagctgccgatgtaaaatgggaagatcaggcagaaatatcaggaagcagtccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacgtttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccagttgacctatgtagtcatagccatcctcacagtggtggccgcaaccatggcaaatgagatgggtttcctggaaaaaaccaagaaagacctcggactgggaagcattataacccaggaatctgagagcaacatcctggacatagatttacgtcctgcatcagcatggacgctgtatgccgtggccacaacatttgttacaccaatgttgagacatagcatcgaaaattcctcagtgaatgtctccctaacagccattgctaaccaggccacagtgctaatgggtcttgggagaggatggccattgtcaaagatggacatcggagttcccctccttgccattggatgctattcacaagtcaaccctataactctcacagcagcccttcttttgctggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgacccaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggaccttggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactaatgaggattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcggacaagtcggcacctatggccttaatactttcaccaacatggaagcccaattaattagacagatggagggagaaggaatttttaaaagcattcagcacctgacagtcacagaagaaatcgctgtacagaactggctagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaagccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccatggatggaagacaaaactctagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6727 - RNA, 9876 nt, synthetic construct
  misc_feature 1..9876: note = derived and/or modified CDS sequence (wt) from DENV-2__EU482556__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgtccagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgtctctcatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcgtcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccgttttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccctggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgaggaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtggagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttggataacatcaacacacctgaaggaatcattcctagcatgttcgaaccagagcgtgaaaaggtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaactcttatgactcagaaggcaagagacgcactggacaacttagctgtgctgcatacggctgaggtaggtggaagggcttacaatcatgctctcagtgaactgccggagaccctggagacactgcttttactgacactcctggctacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggcttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacgtgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacactcagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaatcgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagatgtgagcaagaaggaagggggagcaatgtacgccgatgacacagcaggatgggacacgagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaatatggaagcccaattaattagacagatggagggagaaggaatttttaaaagcattcagcgcctgacagtcacagaagaaatcgctgtgcagaactggttagtaagagtggggcgtgaaaggctatcaagaatggccgtcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtctggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6728 - RNA, 9876 nt, synthetic construct
  misc_feature 1..9876: note = derived and/or modified CDS sequence (wt) from DENV-2__EU529693__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggggttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatggaacatgtaccaccacaggagaacacagaagggaaaaaagatcagtggcactcgttccacatgtgggcatgggactggagacacgaactgaaacatggatgtcatcagaaggggcctggaaacacgttcagagaattgaaacctggatcttgagacatccaggctttaccacaatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggcaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggaatcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattactggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctggtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggggaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatacatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgtttcttagagtttgaagccctaggattcttgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtacaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcatgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcgaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6729 - RNA, 9876 nt, synthetic construct
  misc_feature 1..9876: note = derived and/or modified CDS sequence (wt) from DENV-2__EU482557__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagccttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaatcacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6730 - RNA, 9876 nt, synthetic construct
  misc_feature 1..9876: note = derived and/or modified CDS sequence (wt) from DENV-2__EU482560__SS-prME
  source 1..9876: mol_type = other RNA
acagcaggcgtgattgttatgttgattccaacagtgatggcgttccatttgaccacacgcaatggagaaccacacatgatcgttggtaggcaggagaaagggaaaagtcttctgttcaaaacagaggatggtattaacatgtgtaccctcatggccatagaccttggtgaattgtgtgaagatacaatcacgtacaagtgccctctcctcaaacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccatagggacgacacatttccaaagggccttgattttcatcttactgacagctgtcgctccttcaatgacaatgcgctgcataggaatatcaaacagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaaaggaggcattgtgacctgtgctatgtttacatgcaaaaagaacatggaaggaaaagtcgtacagccagaaaatttggaatacaccatcgtgataacacctcactcaggagaagaacacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcacttttaaaaatccccacgcgaagaaacaggatgtcgttgttttagggtctcaagaaggggccatgcacacggcactcacaggggccacagaaatccagatgtcgtcaggaaacttactgttcacaggacatctcaagtgcaggctgagaatggacaagctacagctcaaaggaatgtcatactctatgtgtacaggaaaatttaaaattgtgaaggaaatagcagaaacacaacatggaacaatagttatcagagtacaatatgaaggagacggttctccatgtaagatcccttttgagataacagatttggaaaaaagacacgtcttaggtcgcctgattacagtcaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggattttggatccctgggaggggtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcttggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaggatgcattttgtgactcaaaactcatgtcagcggccattaaagacaacagagccgtccatgccgatatgggttattggatagaaagtgcactcaatgacacatggaagatggagaaagcctcattcattgaagttaaaagctgccactggccaaagtcacacaccctctggagcaatggagtattagaaagtgagatgataattccaaaaaattttgccgggccagtgtcacaacacaaccacagaccaggttaccatacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatctcttgtgacattgattactgggaacatgtcttttagagaccttggaagagtgatggttatggtgggcgctaccatgacggatgacataggcatgggagtgacttatcttgccctactagcagctttcaaagttagaccaacttttgcagctggactactcttgagaaaactgacctccaaggaattaatgatggccaccataggaattgcactcctttcccaaagcaccataccagagaccattcttgaactgactgatgcgttagccttgggcatgatggtcctcaaaatagtgagaaatatggaaaaataccaattggcagtgactatcatggctatttcgtgcgttccaaatgcagtgatattgcaaaacgcatggaaggtgagttgcacaatattggcagcggtgtccgtttctccactgctcctaacatcctcacagcagaaagcggattggataccactggcattgacgataaaaggtctcaatccaacagccatttttctaacaactctctcgagaaccagcaagaaaaggagctggccgctaaatgaagctatcatggcagtcgggatggtgagcattttagccagttctctcctaaagaatgatattcccatgacaggtccactagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtcttgtgggacgtcccttcacccccaccagtggaaaaagccgaactggaagatggagcctatagaatcaagcaaagagggtttcttggatattctcagattggagccggagtttacaaagaaggaacattccatacaatgtggcacgtcacacgtggtgctgttcttatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacactggaaccataggcgccgtatctttggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaaaacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggacatgaatgggtcacggactttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgattttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagccaaaatgctcctagataacatcaacacacccgaaggaatcattcctagtatgtttgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatttggacaaaagaaggggaaaggaaaaaattaaaacccagatggttggatgctaggatctattctgacccactggcactaaaagaattcaaggaatttgcagctggaagaaaatctttgactctgaacctaatcacagaaatgggtaggcttccaactttcatgactcagaaggcaagaaatgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacacagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttgttggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatttacaagaaaagtggaatccaggaagtggatagaaccctagcaaaagaaggcataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatccccatgtcaacatatgggtggaatctggtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacattgcaaaggaaatatggaggagccttggtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgtgttttcaaagagaaagtggacacgagaacccaagaaccgaaggaaggcacaaagaaactgatgaaaattacggcagagtggctttggaaagaactaggaaagaaaaagacacctagggtgtgtaccagagaagaattcacaagaaaagtgagaagcaatgcagccttgggggccattttcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggtaagaaggaagggggagcaatgtacgccgatgatacagcaggatgggacacaagaatcacactagaagacttaaagaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtggacaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggccatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaaatcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataagtcaagtcagatctcttataggcaatgaggaatacacagactacatgccatccatgaagagattcagaagggaagaggaagaggcaggtgtcctgtggtag

SEQ ID NO: 6731 - RNA, 9876 nt, synthetic construct
  misc_feature 1..9876: note = derived and/or modified CDS sequence (wt) from DENV-2__EU482561__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacatgtgggtatgggactggagacacgaactgaaacatggatgtcatcggaaggggcctggaaacatgttcagagaattgaaacctggatcttgagacatccaggctttaccataatggcagcaatcctggcatacaccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgctgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgttacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaattgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcattatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtgacaagattggagaatctgatgtggaaacaaataacaccagaattgaatcatattctatcagaaaatgaggtaaagttgaccattatgacaggagacatcaaaggaatcatgcaggcaggaaaacgatctttgaggccccagcccactgagctgaagtactcatggaagacatggggaaaggcgaaaatgctctctacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaagatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgtagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagctttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaattctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggggttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggattttgtggtcacaactgacatttcagaaatgggtgccaacttcaaggctgaaagggtcatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctggataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattgcaacccaggaatctgagagcaacatcctggacatagatctacgtcctgcatcagcatggacgctgtatgccgtggctacaacatttgtcacaccaatgttgagacacagcattgaaaattcctcagtgaatgtctccctaacagctatagctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccggaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagagaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacttaggaagcggaacccgcaacattggaattgaaagtgagataccaaacttagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaagacacccaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttaatcatgaaagatggccgcgtgctcgtagtcccatgtagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcggtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6732 - RNA, 9876 nt, synthetic construct
  misc_feature 1..9876: note = derived and/or modified CDS sequence (wt) from DENV-2__EU569703__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacgcaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcacctaggtaagctcgagatggacttcgatttctgcgaaggaaccacagtggtggtgactgaggactgtggaaatagaggaccctctttaagaacgaccactgcctctggaaaacttataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagccagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6733 - RNA, 9876 nt, synthetic construct
  misc_feature 1..9876: note = derived and/or modified CDS sequence (wt) from DENV-2__EU529694__SS-prME
  source 1..9876: mol_type = other RNA
acagcaggcgtgtttattatgttgattccaacagcaatggcgttccatttaaccacacgtaatggagaaccacacatgatcgttggtaggcaagagaaagggaaaagtcttctgttcaaaacagaggacggtgttaacatgtgtaccctcatggccatggaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatccataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgcggcagcgggatcttcatcacggataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaagacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgcagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagccttgggcatgatggtcctcaaaatagtgagaaatatggagaagtaccaattggcagtgactatcatggctatctcgtgtgtcccaaatgcagtgatattgcaaaacgcatggaaggtgagttgcacaatattggcagcggtgtccgtttctccactgctcttgacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcagggagcagcccaatcctgtcaataacaatatcagaggatggcagcatgtcgataaaaaatgaagaggaagaacaaacactgactatactcatcagaacgggattgttggtgatctcaggagtctttccagtatcgataccaatcacggcagcagcatggtacttgtgggaagtgaagaaacaacgggctggagtattgtgggacgtcccttcacccccaccagtgggaaaggccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcggctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctggataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaaggaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagatctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacggctattgctaaccaagccacagtgctaatgggtcttgggaaaggatggccattgtcaaagatggacatcggagttcccctccttgccattggatgctactcacaagtcaaccctataactctcacagcagcccttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatctcaaggatgttgattaacagattcacaatgaaacacaagaaagccacctacgagccagatgttgacttaggaagcggcacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6734 - RNA, 9876 nt, synthetic construct
  misc_feature 1..9876: note = derived and/or modified CDS sequence (wt) from DENV-2__EU529695__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgctgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctaaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6735 - RNA, 9876 nt, synthetic construct
  misc_feature 1..9876: note = derived and/or modified CDS sequence (wt) from DENV-2__EU482562__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggatggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgatactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctactatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagcataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatttatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6736 - RNA, 9876 nt, synthetic construct
  misc_feature 1..9876: note = derived and/or modified CDS sequence (wt) from DENV-2__EU482565__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgctggtgcaactctacgtccacatgggtaacttatgggacatgtaccaccacaggagaacacagaagagaaaaaagatcagtggcactcgttccacatgtaggcatgggactggagacacgaactgaaacatggatgtcatcagaaggggcctggaaacatgttcagagaattgaaacctggatcttgagacatccaggcttcaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacgcaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacatcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatcccctccaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcagggaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgacgtaaaatgggaagatcaggcagaaatatcaggaagcagcccaatcctgtcaataacaatatcagaagatggcagcatgtcgataaaaaatgaagaggaagaacatacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgttaagaaagacctaatatcatatggaggaggctggaagctagaaggagaatggaaagaaggagaggaagtccaagtcttggcattggaacctggaaaaaatccaagagccgtccaaacgaaacctggacttttcaagaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagccagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggttacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagtggaaaaggtatagggaaaatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaacctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacgttggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagctagtcatgaaagatggccgcgtgctcgtggtcccatgcagaaaccaagatgaactgattggtagagcccgaatctctcagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6737 - RNA, 9876 nt, synthetic construct
  misc_feature 1..9876: note = derived and/or modified CDS sequence (wt) from DENV-2__EU529700__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaattctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttctatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttgctgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggaccatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagaccattcttgaactgactgatgcgttagccttgggcatgatggtcctcaaaatagtgagaaatctggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagacggaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactatgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcatacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccatatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccgacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6738 - RNA, 9876 nt, synthetic construct
  misc_feature 1..9876: note = derived and/or modified CDS sequence (wt) from DENV-2__EU529701__SS-prME
  source 1..9876: mol_type = other RNA
acagcaggcgtgattattatgttgattccaacagcgatggcgttccatctaaccacacgtaatggagaaccacacatgatcgttggtaggcaagagaaagggaaaagtcttctgttcaaaacagaggatggtgtcaacatgtgtaccctcatggccatggaccttggtgaattgtgtgaagatacaatcacgtacaagtgtcccctcctcaggcaaaatgaaccagaagacatagactgttggtgcaactctacgtccacatgggtaacttatggaacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttgctgacagctgtcgctccttcaatgacaatgcgttgtataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccaccctaaggaagtactgtatagaagcaaagctgaccaatacaacaacagaatctcgctgcccaacacaaggggaacccagtctaaatgaagagcaggacaaaaggttcctctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctgtaggaaaggctctccaccaagttttcggagcaatctatggggctgcttttagtggggtctcatggactatgaaaatcttcataggagtcatcatcacatggataggaatgaattcacgtagcacctcactgtctgtgtcactagtgttggtgggagtcgtgacactgtacctgggagctatggtgcaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagattatggttttggagtttttaccaccaatatatggctaaaattgagagaaaaacaggatgtattttgtgactcaaaactcatgtcagccgccataaaagacaacagagccgtccatgccgatatgggttattggatagaaagtgcactcaatgacacatggaagatggagaaagcctctttcattgaagttaaaagctgtcactggccaaagtcacacaccctctggagtaatggagtattagaaagtgagatgataattccaaaaaattttgccgggccagtgtcacaacacaactacagaccaggctaccatacacaaacagcaggaccttggcatctaggtaagctagagatggactttgatttctgcgaaggaactacagtggtggtgactgaggactgtggaaatagaggaccctctttaagaacgaccactgcctctggaaaactcataacagaatggtgctgcagatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttccccactgctcttaacatcctcacagcagaaagcagattggataccactggcattgacgataaaaggcctcaatccaacagccatttttctaacaaccctttcgagaaccagcaagaaaaggagctggccgctaaatgaagctatcatggcagtcgggatggtaagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccggtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaggaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaaaacaaaaagataccttccagccatagttagagaagccataaaacgtggcttgagaacattaatcctggctcccactagagtcgtggcagctgaaatggaggaagctcttagaggacttccaataagataccaaaccccagctatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatctcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttagaaaaaatggaaagaaagtgatacaactcagtagaaagacttttgactctgagtatgttaagactagagccaatgattgggactttgtggtcacaactgacatttcagaaatgggtgccaacttcaaggctgagagggttatagaccccagacgctgtatgaaaccagttatactaacagatggcgaagagcgggtgatcttggcaggacctatgccagtgacccactctagtgcagcgcaaagaagagggagaataggaagaaatccaaaaaatgaaaatgaccagtatatatacatgggggaacctctggaaaatgatgaagactgtgcacattggaaagaagctaaaatgctcctagacaacatcaacacacctgaaggaatcattcctagtatgttcgaaccagagcgtgaaaaagtggatgccattgatggtgaataccgtttaagaggagaagcaaggaaaacctttgtggatctaatgagaagaggggacttaccagtctggttggcctacagagtggcagctgaaggcatcaactacgcagacagaaggtggtgttttgatggaatcaagaacaaccaaatactggaagaaaacgtggaagtggaaatctggacaaaagaaggggaaaggaagaaattaaaacccagatggttggatgctagaatctattctgacccactggcactaaaagaattcaaggaatttgcagctggaagaaaatctttgaccctgaacctaattacagaaatgggtaggcttccaactttcatgactcagaaggcaagagacgcactggacaacttagctgtgctgcatacggctgaggcaggtggaaaggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaagaatctgagagcaacatcctagacatagatctacgtcctgcatcagcatggacgctgtatgccgtggctacaacatttgtcacaccaatgctgagacatagcattgaaaattcctcagtgaatgtctccctaacagccattgctaaccaagccacagtgctaatgggtcttgggaaaggatggccattgtcaaagatggacatcggagttcccctccttgccattggatgctactcacaagtcaaccctataactctcacagcagctcttcttttgttggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgagaagcagttaggacaagtaatgctcctaatcctctgcgtgactcaagtactaatgatgaggactacatgggctctgtgtgaggctctaaccttagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgatcaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacgtcatggcactatgaccaagaccacccatacaaaacgtgggcttaccatggcagttatgaaacaaaacaaactggatcagcatcatctatggtgaacggagtggtcaggctgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctagaatgtgtactagagaagaattcacaagaaaggtgagaagcaatgcagccttgggagccatattcactgatgagaacaaatggaagtcggcacgtgaggctgttgaagatagtaggttctgggagctggttgacagggaaagaaatctccatcttgaaggaaagtgtgaaacatgtgtgtacaacatgatgggcaaaagagagaagaaactaggggagttcggcaaggcaaaaggtagcagagccatatggtacatgtggcttggagcacgcttcttagagtttgaagccctaggattcttgaatgaagaccactggttctccagagggaactctctgagtggagtggaaggagaagggctgcataggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaacactttcaccaacatggaagcccaattaattagacagatggaaggagaaggaatcttcaagagcattcagcacttgacagttacagaagaaatcgctgtacagaactggttagcaagagtgggacgtgaaaggctatcaagaatggccatcagtggagatgattgtgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6739 - RNA, 9876 nt, synthetic construct
  misc_feature 1..9876: note = derived and/or modified CDS sequence (wt) from DENV-2__EU569704__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacttccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcctctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggaatcttaggaatggcactgttcctggaagaaatgcttaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtcttaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggccacaacatttgtcacaccaatgttgagacatagcattgaaaattcctcagtgaatgtctccctaacagctattgctaaccaagccacagtgctaatgggtcttgggaaaggatggccattgtcaaagatggacattggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttatcatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaagagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6740 - RNA, 9876 nt, synthetic construct
  misc_feature 1..9876: note = derived and/or modified CDS sequence (wt) from DENV-2__EU482568__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcctctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattagaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatatagaggtgaggatggatgctggtacgggatggaaatcagaccattgaaagagaaagaggagaatttggtcaactccttggtcacagccggacatgggcagattgacaacttttcactaggaatcttaggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtcttaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacttgtgggaagtgaagaaacaacgggctggagtattgtgggacgtcccttcacccccaccagtggaaaaagccgaactggaagatggagcctatagaatcaagcaaagagggattcttggatattctcagattggagccggagtttacaaagaaggaacatttcatacaatgtggcacgtcacacgtggtgctgttctgatgcatagagggaagagggttgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagactgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggccacaacatttgtcacaccaatgttgagacatagcattgaaaattcctcagtgaatgtctccctaacagctattgctaaccaagccacagtgctaatgggtcttgggaaaggatggccattgtcaaagatggacattggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacaaatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatctcccagggagccgggtggtctttgaaggagacggcctgtttggggaagtcttacgcccaaatgtgggccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6741 - RNA, 9876 nt, synthetic construct
  misc_feature 1..9876: note = derived and/or modified CDS sequence (wt) from DENV-2__EU482569__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaagactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaatataggagagacacttggagaaaaatggaaaagccgattaaacgcactgggaaaaaatgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcataccagaagggaaggtggtggacctcggttgcggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttctttaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgatctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6742 - RNA, 9876 nt, synthetic construct
  misc_feature 1..9876: note = derived and/or modified CDS sequence (wt) from DENV-2__EU482570__SS-prME
  source 1..9876: mol_type = other RNA
acagcaggcgtgattattatgttgattccaacagcgatggcgttccatttaaccacacgcaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatataccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcctctgcaaacactccatggtagacagaggatggggaaatggatgtggattatttggaaagggaggcattgtgacctgtgctatgtttacatgcaaaaagaatatggaaggaaaagtcgtgcagccagaaaatttggaatacaccatcgtgataacacctcactcaggagaagagcacgctgtaggcaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtacaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaagtaacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattagaaagtgagatgataattccaaaaaattttgctgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacctatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgggttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcggaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaaaaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaggaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacactgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaaaggcgtacaatcatgctctcagtgaactgccggaaaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctggacatagatctacgtcctgcatcagcatggacgctgtatgccgtggccacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctactcacaagtcaaccctataacactcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattgatgatgaggactacatgggctctgtgtgaggctctaaccttagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatacatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctagggagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaattcacaagaaaggtgagaagcaatgcagccttgggggccatattcactgatgagaacaaatggaaatcggcacgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggggcacgcttcttagagtttgaagccctaggattcttgaatgaagatcactggttctccagagggaactccctgagtggagtggaaggagaagggctgcacaggctaggctacattttaaaagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaggtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggtcatcagtggagatgattgtgttgtaaagcctttagatgacagatttgcaagtgctttaacagctctaaatgacatgggaaaagttaggaaagatatacaacaatgggaaccctcaagaggatggaacgattggacacaagtgcctttctgttcacaccattttcatgagttagtcatgaaagatggtcgcgtgctcgtagtcccgtgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacattcaaacagcaataaatcaagtcagatcccttataggcaatgaagaatacacagactacatgccatccatgaagagatttagaagggaagaggaagaggcaggtgtcctatggtag

SEQ ID NO: 6743 - RNA, 9876 nt, synthetic construct
  misc_feature 1..9876: note = derived and/or modified CDS sequence (wt) from DENV-2__EU482571__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagaacaggacaaaaggttcctctgcaaacactccatggtggacagaggatggggaaatggatgtggattatttggaaagggaggcattgtgacctgtgctatgtttacatgcaaaaagaacatggaaggaaaagtcgtgctgccagaaaatttggaatataccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctttggaaaatgatgaagactgtgcacattggaaagaagctaaaatgcttctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgttgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaattctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaagggggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaacgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagcgtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6744 - RNA, 9876 nt, synthetic construct
  misc_feature 1..9876: note = derived and/or modified CDS sequence (wt) from DENV-2__EU482572__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttactataatggcagcaatcctggcatataccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtaacgacgatggcaaaaaataaaccaacattggattttgaactaataaaaacagaagccaaacaacctgccactctaaggaagtactgtatagaagcaaagctgaccaatacaacaacagaatctcgttgcccaacacaaggggaacccagtctaaatgaagagcaggacaaaaggttcctctgcaaacactccatggtagacagaggatggggaaatggatgtggattatttggaaagggaggcattgtgacctgtgctatgtttacatgcaaaaagaacatggaaggaaaagtcgtgcagccagaaaatctggaatacaccatcgtgataacaccccactcaggagaagagcacgctgtaggcaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccatcttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtacaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaagtaacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaggatgtattttgtgactcaaaactcatgtcagctgccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattagaaagtgagatgataattccaaaaaattttgctgggccagtgtcacaacacaactacagaccaggctaccatacacaaacagcaggaccttggcatctaggtaagcttgagatggactttgatttctgcgaaggaactacagtggtggtgactggggactgtggaaatagaggaccctctttaagaacgaccaccgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacctatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagtggtgtccgtttctccactgcttttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcggaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctttgggaagtgaaaaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggatcgaaccatcatgggcagacgtcaagaaagacttaatatcatatggaggaggctggaagctagaaggagaatggaaggaaggagaggaagtccaagtcctggcattggaacctggaaaaaatccaagagccgtccaaacaaaacctggacttttcaaaactaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcctactagagtcgtggcagctgaaatggaggaagctcttagaggacttccaataagataccaaaccccagccatcagagccgagcacactgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaaaggcgtacaatcatgctctcagtgaactgccggaaaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctactcacaagtcaaccctataacactcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtaatgatgatgaggactacatgggctctgtgtgaggctctaaccttagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaagagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatacatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctagggagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaagcaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaattcacaagaaaggtgagaagcaatgcagccttgggggccatattcactgatgagaacaaatggaaatcggcacgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggggcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggtcatcagtggagatgattgtgttgtaaagcctttagatgacagatttgcaagtgctttaacagctctaaatgacatgggaaaagtcaggaaagatatacaacaatgggaaccttcaagaggatggaacgattggacacaagtgcctttctgttcacaccattttcatgagttagtcatgaaagatggtcgcgtgctcgtagtcccgtgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacattcaaacagcaataaatcaagtcagatcccttataggcaatgaggaatacacagactacatgccatccatgaagagatttagaagggaagaggaagaggcaggtgtcctgtggtag

SEQ ID NO: 6745 - RNA, 9876 nt, synthetic construct
  misc_feature 1..9876: note = derived and/or modified CDS sequence (wt) from DENV-2__EU482573__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcctctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggggctatggtgcaggctgatagtggttgcgttgtgagctggaaaaataaagaactgaaatgtggcagcgggatcttcattacagacaacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgagctggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaaaacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaggggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctggtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatacatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaagtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6746 - RNA, 9876 nt, synthetic construct
  misc_feature 1..9876: note = derived and/or modified CDS sequence (wt) from DENV-2__EU482574__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcctctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcatatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggggccatggtgcaggctgatagtggttgcgttgtgagctggaaaaataaagaactgaaatgtggcagcgggatcttcattacagacaacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgagctggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaaaacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggccacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaggggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctggtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatacatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaagtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaattttcaaaagcatccagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6747 - RNA, 9876 nt, synthetic construct
  misc_feature 1..9876: note = derived and/or modified CDS sequence (wt) from DENV-2__EU482575__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacgcagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcctctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggagccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagcccatgaagagggcatttgcggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagtaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggatttttatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgactctgagtatgtcaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccattgatggtgaataccgtttgagaggagaagcaaggaaaacctttgtagacctaatgagaagaggggacttaccagtctggttggcttacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtataatcatgctctcagtgaactgccggagaccctggagacactgcttttactgacactcctggccacagtcacaggaggaatcttcttattcttaatgagcggaaaaggtatagggaaaatgaccctgggaatgtgttgcataatcacggctagcatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttggcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtccttaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgaccttagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggtaatgaggaatacacagactacatgccatccatgaagagattcagaagggaagaggaagaggctggtgtcctgtggtag

SEQ ID NO: 6748 - RNA, 9876 nt, synthetic construct
  misc_feature 1..9876: note = derived and/or modified CDS sequence (wt) from DENV-2__EU482578__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtatgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaactaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggtaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagatgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggcctcaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttaaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttgggaaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6749 - RNA, 9876 nt, synthetic construct
  misc_feature 1..9876: note = derived and/or modified CDS sequence (wt) from DENV-2__EU482580__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatggaccttggtgaattgtgtgaagatacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttgctgacagctgtcgctccttcaatgacaatgcgttgtataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccaccctaaggaagtactgtatagaagcaaagctgaccaatacaacaacagaatctcgctgcccaacacaaggggaacccagtctaaatgaagagcaggacaaaaggttcctctgcaaacactccatggtagacagaggatggggaaatggatgtggattatttggaaagggaggcattgtgacctgtgctatgtttacatgtaaaaagaacatggaaggaaaagtcgtgcagccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggttactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcttcataggagtcatcatcacatggataggaatgaattcacgtagcacctcactgtctgtgtcactagtgttggtgggagtcgtgacactgtacctgggagctatggtgcaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagattatggttttggagtttttaccaccaatatatggctaaaattgagagaaaaacaggatgtattttgtgactcaaaactcatgtcagccgccataaaagacaacagagccgtccatgccgatatgggttattggatagaaagtgcactcaatgacacatggaagatggagaaagcctctttcattgaagttaaaagctgtcactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgcagatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttccccactgctcttaacatcctcacagcagaaagcggattggataccactggcattgacgataaaaggtctcaatccaacagccatttttctaacaaccctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccggtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaggaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagctatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatctcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagtagaaagacttttgactctgagtatgttaagactagagccaatgattgggactttgtggtcacaactgacatttcagaaatgggtgccaacttcaaggctgagagggttatagaccccagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtatatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgtttaagaggagaagcaaggaaaacctttgtggatctaatgagaagaggggacttaccagtctggttggcctacagagtggcagctgaaggcatcaactacgcagacagaaggtggtgttttgatggaatcaagaacaaccaaatactggaagaaaacgtggaagtggaaatctggacaaaagaaggggaaaggaagaaattaaaacccagatggttggatgctagaatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaaaggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaagaatctgagagcaacatcctggacatagatctacgtcctgcatcagcatggacgctgtatgccgtggctacaacatttgtcacaccaatgctgagacatagcattgaaaattcctcagtgaatgtctccctaacagccattgctaaccaagccacagtgctaatgggtcttgggaaaggatggccattgtcaaagatggacatcggagttcccctccttgccattggatgctactcacaagtcaaccctataactctcacagcagctcttcttttgttggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgagaagcagttaggacaagtaatgctcctaatcctctgcgtgactcaagtactaatgatgaggactacatgggctctgtgtgaggctctaaccttagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacgtcatggcactatgaccaagaccacccatacaaaacgtgggcttaccatggcagttatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctagaatgtgtactagagaagaattcacaagaaaggtgagaagcaatgcagccttgggagccatattcactgatgagaacaaatggaagtcggcacgtgaggctgttgaagatagtaggttttgggagctggttgacagggaaagaaatctccatcttgaaggaaagtgtgaaacatgtgtgtacaacatgatgggcaaaagagagaagaaactaggggagttcggcaaggcaaaaggtagcagagccatatggtacatgtggcttggagcacgcttcttagagtttgaagccctaggattcttgaatgaagaccactggttctccagagggaactccctgagtggagtggaaggagaagggctgcataggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaacactttcaccaacatggaagcccaattaattagacagatggaaggagaaggaatcttcaagagcattcagcacttgacagttacagaagaaatcgctgtacagaactggttagcaagagtgggacgtgaaaggctatcaagaatggccatcagtggagatgattgtgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6750 - RNA, 9876 nt, synthetic construct
  misc_feature 1..9876: note = derived and/or modified CDS sequence (wt) from DENV-2__EU482581__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgatttttatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacaggaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactacttttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctactatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactatgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6751 - RNA, 9876 nt, synthetic construct
  misc_feature 1..9876: note = derived and/or modified CDS sequence (wt) from DENV-2__EU482582__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgaaccatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgtttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctactatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagcatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcactacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcaacagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6752 - RNA, 9876 nt, synthetic construct
  misc_feature 1..9876: note = derived and/or modified CDS sequence (wt) from DENV-2__EU482583__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggtagacatagtcttagaacatggaagttgtgtgacgacgatggcaaaaaataaaccaacattggattttgaactgataaaaacagaagccaaacagcctgccactctaaggaagtactgtatagaagcaaagctgaccaatacaaccacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagctgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaggacaacagagccgtccatgccgatatgggttattggatagaaagtgcactcaatgacacatggaagatggagaaagcctctttcattgaagttaaaagctgccactggccaaagtcacacactctctggagcaatggagtattggaaagtgagatgataattccaaaaaattttgctgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacagatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgacttggaactggagagagctgccgatgtaaaatgggaagatcaggcagaaatatcaggaagcagcccaatcctgtcaataacaatatcagaagatggcagcatgtcgataaaaaatgaagaggaagaacaaacactgactatactcatcagaacgggattgttggtgatctcaggagtctttccagtatcgataccaatcacggcagcagcatggtatttgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctgggaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgacgctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctcttagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtagccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatttttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgatcaacagattcacaatgaaacacaagaaagccacctacgagccagatgttgatctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgttgtccctatggtgacacagatggcaatgacagacacgactccatttggacaacaacgcgttttcaaagagaaagtggacacgagaacccaagaaccgaaggaaggcacaaagaaattgatgaaaattacggcagaatggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgtttcttagagtttgaagccctaggattcttgaatgaagatcactggttctccagagggaactccctgagtggagtggaaggagaagggctgcacagactaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtatttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattaattgggctaacaagcagggctacctgggctaagaacatccaaacagcaataaatcaagtcagatcccttataggcaatgaggaatacacagactacatgccatctatgaagagattcagaagggaagaggaagaggccggtgtcctgtggtag

SEQ ID NO: 6753 - RNA, 9876 nt, synthetic construct
  misc_feature 1..9876: note = derived and/or modified CDS sequence (wt) from DENV-2__EU482585__SS-prME
  source 1..9876: mol_type = other RNA
acagcaggcgtgattattatgttgattccaacagcgatagcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggaggcattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatggtaattccaaaaaattttgccggaccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgacgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagttgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacaaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagaaatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggcttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacagtaacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagaaaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggaaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaaatcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6754 - RNA, 9876 nt, synthetic construct
  misc_feature 1..9876: note = derived and/or modified CDS sequence (wt) from DENV-2__EU482587__SS-prME
  source 1..9876: mol_type = other RNA
acagcaggcgtgattattatgttgattccaacagcgatggcgttccatttaaccacacgtaatggagaaccacacatgatcgttggtaggcaagagaaggggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaaaggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagtagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggctatgcacacggcactcacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctaattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagttggaaaagtagagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcggacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtgttggaaagtgagatgataattccaaaaaattttgccgggccagtgtcacaacacaactacagaccaggctaccacacacaaacagcaggaccttggcatctaggtaagcttgagatggactttgatttctgcgaaggtaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtaaactccttggttacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaactttcgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagagtggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattataacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgttgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagatagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggcgtcctgtggtag

SEQ ID NO: 6755 - RNA, 9876 nt, synthetic construct
  misc_feature 1..9876: note = derived and/or modified CDS sequence (wt) from DENV-2__EU482588__SS-prME
  source 1..9876: mol_type = other RNA
acagcaggtgtgattattatgttgattccaacagcgatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacaggagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaaggtcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcgttacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagatattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgtacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgttacacgtggtgctgttctgatgcatagagggaagaggattgaaccatcatgggcagacgtcaagaaagacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagccgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaatctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttagatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataaccctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaatactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgaaagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaacaacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggtagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagaccactggttctccagagggaactccctgagtggagtggaaggagaagggctgcacaggctaggctacatcttaagagacgtgagcaagaaggaagggggagcaatgtacgccgatgatacagcagggtgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6756 - RNA, 9876 nt, synthetic construct
  misc_feature 1..9876: note = derived and/or modified CDS sequence (wt) from DENV-2__EU569705__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacatgtgggtatgggactggagacacgaactgaaacatggatgtcatcggaaggggcctggaaacatgttcagagaattgaaacctggatcttgagacatccaggctttaccataatggcagcaatcctggcatacaccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtgacaagattggagaatctgatgtggaaacaaataacaccagaattgaatcacattctatcagaaaacgaggtaaagttgaccattatgacaggagacatcaaaggaatcatgcaggcaggaaaacgatctttgaggccccagcccactgagctgaagtactcatggaagacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgcagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaggccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggattttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctggataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctatagctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccggaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacttaggaagcggaacccgcaacattgtaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaacgaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgtcgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6757 - RNA, 9876 nt, synthetic construct
  misc_feature 1..9876: note = derived and/or modified CDS sequence (wt) from DENV-2__EU482589__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcactcgttccacatgtgggtatgggactagagacacgaactgaaacatggatgtcatcagaaggggcctggaaacatgttcagagaattgaaacctggatcctgagacatccaggctttaccataatggcagcaatcctggcatacaccataggaacaacacatttccaaagggccttgattttcatcctactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaatgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggacgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctccccatgtaagatcccttttgagataatggatttggaaaaaagacacgtcttaggtcgcctgattacagttaacccaatcgtaacagaaaaagatagcccagtcaacatagaagcagaacccccattcggagacagctacattatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagaatctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaatttagccgggccagtgtcacaacacaattacagaccaggctaccacacacaaacagcaggaccttggcatctaggtaagcttgagatggactttgatttctgtgaaggaaccacagtggtggtgactgaggactgtggaaatagaggaccctctttaagaacgaccactgcctctggaaaactcgtaacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaggtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatacgtgagtgctatagcccagaccgaaaaaagcattgaagacaatccagagatcgaagatgacattttccgaaagaaaagattgaccatcatggacctccatccaggagcaggaaagacaaaaagatatcttccagccatagttagagaagccataaaacgtggcttgagaacattaatcctggctcccactagagtcgtggcagctgaaatggaggaagctcttagaggacttccaataagataccaaaccccagccattagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacccatgccagtgacccactctagtgcagcgcaaagaagagggagaataggaagaaatccaaaaaatgaaaatgaccagtacatatatatgggggaacccctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatccttgaccctgaacctaatcacagaaatgggtaggcttccaactttcatgactcagaaggcaagaaacgcactggacaatttagctgtgctgcatacggctgaggcaggtggaagggcgtacaatcatgctctcagtgaactgccggagaccctggagacactgcttttactgacactcctggccacagtcacaggaggaatctttttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctctctaacagctattgctaaccaagccacagtgctaatgggtcttgggaaaggatggccattgtcaaagatggacatcggagttcccctccttgccattggatgctactcacaagtcaaccctataaccctcacagcagcccttcttttattggtagcacattatgccattatagggccaggacttcaagcaaaagcaaccagagaagctcagaaaagagcagcagcaggtatcatgaaaaacccaacagttgatggaataacagtgattgacctagaaccaataccctacgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaatatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggatacgagaactcaagaaccgaaggaaggcacaaagaaactgatgaaaattacggcagagtggctttggaaagaactaggaaaggaaaagacacccaggatgtgtaccagagaagaatttacaagaaaggtgagaagcaatgcagccttgggggccatattcactgatgagaacaaatggaaatcggcacgcgaggctgttgaagatagtaggttttgggagctgattgacagggaaagaaatctccatcttgaaggaaagtgtgaaacatgtgtgtacaacatgatgggaaaaagagagaagaaactaggggagttcggtaaggcaaaaggtagcagagccatatggtacatgtggcttggagcacgcttcttagagtttgaagccctaggattcttgaatgaagatcactggttctccagagagaactccctgagtggagtggaaggagaggggctgcacaggctaggctacattttaagagacgtgagcaagaaggaagggggagcaatgtacgccgatgatacagcaggttgggacacaagaatcacactagaagacttaaaaaatgaagaaatggtaacaaaccacatgaaaggagaacacaagaaactagcagaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagccacagaagaaatcgctgtacagaactggttagcaagagtggggcgtgaaaggctatcaagaatggccatcagtggagatgattgtgttgtaaaacctttggatgacagatttgcaagtgccttaacagccctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaaatcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcttgtggtag

SEQ ID NO: 6758 - RNA, 9876 nt, synthetic construct
  misc_feature 1..9876: note = derived and/or modified CDS sequence (wt) from DENV-2__EU569706__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggtcgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttctatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttgctgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggaccatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagaccattcttgaactgactgatgcgttagccttgggcatgatggtcctcaaaatagtgagaaatctggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttataaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagacggaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactatgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcggtgaatgtctccttaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaggggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaaacaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccatatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacgcaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6759 - RNA, 9876 nt, synthetic construct
  misc_feature 1..9876: note = derived and/or modified CDS sequence (wt) from DENV-2__EU569707__SS-prME
  source 1..9876: mol_type = other RNA
acagcaggcgtgattattatgttgattccaacagcaatggcgttccatttaaccacacgtaatggagaaccacacatgatcgttggtaggcaagaaaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcacttgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggactttgaactgataaaaacagaagccaaacagcctgccactctaaggaagtactgtgtagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcggatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagaaccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaaatactcatggaagacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacggaatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgcagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagccttgggcatgatggtcctcaaaatagtgagaaatatggagaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcggcatggtacttgtgggaagtgaagaaacaacgggctggagtattgtgggacgtcccttcacccccaccagtgggaaaggccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagctagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggactttgtggtcacaactgacatttcagaaatgggtgccaacttcaaggctgaaagggttatagaccccagacgttgcatgaaaccagtcatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctggataacatcaacacacctgaaggaatcattcctagtatgttcgaaccagagcgtgaaaaggtggatgccatcgatggtgaataccgcttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaaggaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagatctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacggctattgctaaccaagccacagtactaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatctaatgctaccgggaacatagtgtcatcagtgaacatgatttcaaggatgttgattaacagattcacaatgaaacacaagaaagccacctacgagccagatgttgacttaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaaaacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtgacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6760 - RNA, 9876 nt, synthetic construct
  misc_feature 1..9876: note = derived and/or modified CDS sequence (wt) from DENV-2__EU660399__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgtcccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagttaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagtttttggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaagacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgcagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgcttttaacatcctcacagcagaaagcggattggataccactggcattgacgataaaaggtctcaatccaacagccatttttctaacaactctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtgaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaggccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagacaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaaaataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggatgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacctagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaatttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgatcaacagattcacaatgaaacacaagaaagccacctacgagccagatgttgacttaggaagcggaacccgcaacattggaattgaaagtgagataccaaacctagatataataggaaagagaatagagaaaataaagcaagagcatgaaacatcatggcactatgaccaagaccacccatacaaaacgtgggcttaccatggcagctacgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagcaggttttgggagctgattgacagggaaagaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcctagagtttgaagccctaggattcttgaatgaagatcactggttttccagagggaactccctgagtggagtggaaggagaagggctgcacaggctaggctacattttaagagacgtgagcaagaaggaagggggagcaatgtacgccgatgatacagcaggatgggacacaagaatcacactagaagacttgaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttgacagctctaaatgacatgggaaaagttaggaaagatatacaacaatgggaaccttcaagaggatggaatgattggacacaagtgcctttctgttcacaccattttcatgagttagtcatgaaagatggccgcgtgctcgtagtcccatgcagaaaccaagacgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6761 - RNA, 9876 nt, synthetic construct
  misc_feature 1..9876: note = derived and/or modified CDS sequence (wt) from DENV-2__EU569708__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgaggcatccaggctttgccataatggcagcaatcttggcatacaccataggaacgacacatttccaaagggccttgattttcatcttactgacagctgtcgctccttcaatgacaatgcgttgcataggaatatcaaatagagactttgtagaaggggtttcaggtggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgtttacatgcaaaaagaacatggaaggaaaagtcgtgctgccggaaaatctggaatacaccatcgtgataacacctcactcaggagaagagcacgctgtaggcaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagagaaagcttggctggtgcacaggcaatggttcctagacctgccgttaccatggctacccggagcggacacacaaggatcaaattggatacagaaagagacattggtcactttcaaaaatccccacgcgaagaaacaggatgtcgtagttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaattgtaacagaaaaagatagcccagtcaacatagaagcagaacctccatttggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgcagcacctcactgtctgtgtcactagtattggtgggagtcgtgacactgtacctgggagctatggtgcaggctgatagtggttgcgttgtgagctggaaaaacaaagaactgaaatgtggcagcgggatcttcattacagataacgtgcacacatggacggaacaatataagttccaaccagaatccccttcaaaactagcttcagccatccaaaaagctcatgaagagggcatttgtggaatccgctcagtaacaagattggagaatctgatgtggaaacaaataacaccagaattgaatcacatcctatcagaaaatgaggtaaagttgaccattattacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgagacagcagaatgccccaacacaaacagagcttggaactcactggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcacttaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccatacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatatagaggtgaggatggatgctggtacgggatggaaatcagaccattaaaagagaaagaggagaatttggtcaactccttggtcacggccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttaccttgccctactagcagctttcaaagttagaccaactttcgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagttagaaacatggaaaagtaccaattggcagtgactatcatggctatctcgtgtgtcccaaatgcagtgatactgctaaacgcatggaaggtgagttgcacaatattggcagcggtgtccgtttctccattgctcttaacatcctcacagcagaaaacggattggataccactggcattgacgataaaaggtctcaatccaacagccatttttttaacaactctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttatgtgctcactggacgatcggccgatttggaactggagagagctgccgatgtaaaatgggaagatcaggcagaaatatcaggaagcagcccaatcctgtcagtaacaatatcagaagatggcagcatgtcgataaaaaatgaagaggaagaacaaacactgaccatactcattagaacgggattgctggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaacaccggaactataggcgccgtatctctggacttttcccctggaacgtcaggatctccaattgtcgacagaaaaggaaaagttgtgggtctttacggcaatggtgttgtcacaaggagtggagcatatgtgagtgctatagcccagaccgaaaaaagcatcgaagacaatccagagatcgaagatgacattttccgaaagaaaagattgaccatcatggacctccatccaggagcaggaaagacaaaaagataccttccagccatagttagagaagccataaaacgtggcttgagaacattaatactggcccccactagagttgtggcagctgaaatggaggaagctcttagaggacttccaataagataccaaaccccagccatcagagcagagcacaccgggcgggagatcgtggacctaatgtgtcatgccacatttactatgaggctgctatcaccagtcagagtgccaaattacaacctgatcatcatggacgaagcccacttcacagatccagcaagtatagcagctagaggatacatttcaactcgagtagaaatgggtgaagcagctgggattttcatgacagccactcctccgggaagtagagacccatttcctcagagcaatgcaccaatcatggatgaggaaagagaaatccctgagcgctcgtggaattcaggacatgaatgggtcacggattttaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaggagcgggtgatcttggcaggacctatgccagtgacccactctagtgcagcacaaagaagagggagaataggaagaaatccaaaaaacgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggttgatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcttcagtgaatgtctccctaacagccattgctaaccaagccacagtgttaatgggtcttgggaaaggatggccattgtcaaagatggacatcggagttcccctccttgccattggatgctattcacaagtcaaccctataactctcacagcagctcttcttttattggtagcacattatgccattataggaccaggacttcaagcaaaagcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagcgaccgggcccatctccacactgtgggaaggaaatccagggaggttttggaatactaccattgcagtgtcaatggctaacatctttagggggagctacttggccggagctggacttctcttttccatcatgaagaacacaacaaacacaagaagaggaactggcaacataggagagacacttggagaaaaatggaaaagtcgattaaacgcactgggaaaaagtgaatttcagatctacaagaaaagtggaatccaggaagtggatagaaccttggcaaaagaaggcatcaaaagaggagaaacggaccaccacgctgtgtcgcgaggctcagcaaaattgagatggttcgtcgagagaaatatggtcacaccagaagggaaggtggtggacctcggttgcggcagagggggctggtcatactattgtgggggactgaagaatgtaagagaagtcaaaggcttgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtatcatcagtgaacatgatttcaaggatgttgattaacagattcacaatgaaacacaagaaagccacctacgagccagatgttgacttaggaagcggaacccgcaacattggaattgaaagtgagataccaaatctagacataataggaaagagaatagagagaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagtaatgcagccttgggggccgtattcactgatgagaacaaatggaaatcggctcgtgaggctgttgaagatagtaggttttgggagctggttgacagggaaagaaatctccatcttgaaggaaagtgtgaaacatgtgtgtacaacatgatgggaaaaagagaaaagaaactaggggagttcggcaaggcaaaaggcagcagagccatatggtacatgtggcttggagcacgcttcttagagtttgaagccctaggattcttgaatgaagatcactggttctccagaaggaactccctgagtggagtggaaggagaagggttgcacaggctaggctacattttaagagacgtgagcaagaaggaagggggagcgatgtacgccgatgatacagcaggatgggacacaagaatcacactagaagacctaaaaaatgaagaaatggtaacaaaccacatgaaaggagaacacaagaaactagccgaggccatattcaaattaacgtaccaaaataaggtggtgcgtgtgcaaagaccaacaccaagaggcacagtaatggatattatatcgagaagagaccaaagaggcagcgggcaagtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggccattagtggagatgattgtgttgtaaaacctttagatgacagatttgcaagtgctttaacagctctaaatgacatgggaaaagttaggaaagatatacaacaatgggaaccttcaagaggatggaacgactggacacaagtgcctttctgctcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgaccttagactggcggcaaatgccatttgctcggcagtcccgtcacattgggttccaacaagtcgaacaacttggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtactgtggtag

SEQ ID NO: 6762 - RNA, 9876 nt, synthetic construct
  misc_feature 1..9876: note = derived and/or modified CDS sequence (wt) from DENV-2__EU569709__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgtccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagatacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatctctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaattgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacaactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagactattcttgaactgactgatgcgttagccttgggcatgatggtcctcaaaatagtgagaaatatggaaaagtaccaattggcagtgactatcatggctatcttgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggaggacttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagatgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggagttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacgtttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccagttgacctacgtagtcatagccatcctcacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcatcgaaaattcctcagtgaatgtctccctaacagccattgctaaccaggccacagtgctaatgggtcttgggagaggatggccattgtcaaagatggacatcggagttcccctccttgccattggatgctattcacaagtcaaccctataactctcacagcagcccttcttttgctggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgacccaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactaatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacattagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggctagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggttccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccatggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6763 - RNA, 9876 nt, synthetic construct
  misc_feature 1..9876: note = derived and/or modified CDS sequence (wt) from DENV-2__EU596485__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccgcatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaacacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaagaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagttcaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcattgtctgtgtcactagtattggtgggagtcgtgacactgtacttgggagttatggtgcaggctgatagcggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagactctcacaatcagacctttcttattgatggccctgaaacagcagaatgccccaacacaaacagagcttggaactcactggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttctcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgccaccatgacggatgacataggtatgggagtgacttaccttgccctactagcagctttcaaagttagaccaacttttgcagctggactactcttgagaaaactgacctccaaggaactaatgatggccaccataggaatcgcacttctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagatgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgacggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccgcagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagcccttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactagggaagaaaaagacacctaggatgtgtaccagagaagaatttgcaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaaggactgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6764 - RNA, 9876 nt, synthetic construct
  misc_feature 1..9876: note = derived and/or modified CDS sequence (wt) from DENV-2__EU569710__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaattctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgactttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccattctaaggaagtactgtatagaagcaaagctgaccaatacaacaacagaatctcgttgtccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaagaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagatacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatctctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtaactgaggactgtggaaatagaggaccctctttaagaacaactactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggctctgttcctggaagaaatgctcaggacccgagtaggaacgaaacatgcaatactgctagttgcagtatctttcgtgacattgatcaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagactattcttgaactgactgatgcgttagccttgggcatgatggtcctcaaaatagtgagaaatatggaaaagtaccaattggcagtgactatcatggctatcttgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggaggacttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacactaatcctggctcccactagagttgtggcagctgaaatggaggaagctcttagaggacttccaataagataccaaaccccagccatcagagccgagcacaccgggcgggagatcgtggacctaatgtgtcatgccacgtttactatgaggctgctatcaccagtcagagtgccaaattacaacctgatcatcatggatgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgattttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccagttgacctacgtagtcatagccatcctcacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcatcgaaaattcctcagtgaatgtctccctaacagccattgctaaccaggccacagtgctaatgggtcttgggagaggatggccattgtcaaagatggacatcggagttcccctccttgccattggatgctattcacaagtcaaccctataactctcacagcagcccttcttttgctggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgacccaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactgcaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactaatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggctagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccatggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6765 - RNA, 9876 nt, synthetic construct
  misc_feature 1..9876: note = derived and/or modified CDS sequence (wt) from DENV-2__EU596486__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttactataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgattaaaacagaagccaaacaacctgccactctaaggaagtactgtatagaagcaaagctgaccaatacaacaacagaatctcgttgtccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggccttgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagatacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatctctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcggcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacaactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagactattcttgaactaactgatgcgttagccttgggcatgatggtcctcaaaatagtgagaaatatggaaaagtaccaattggcagtgactatcatggctatcttgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggaggacttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcacagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacgtttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccagttgacctacgtagtcatagccatcctcacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcatcgaaaattcctcagtgaatgtctccctaacagccattgctaaccaggccacagtgctaatgggtcttgggagaggatggccattgtcaaagatggacatcggagttcccctccttgccattggatgctattcacaagtcaaccctataactctcacagcagcccttcttttgctggtagcacattatgccattatagggccaggacttcaagcaaaagcaaccagagaagctcagaaaagagcagcagcgggcatcatgaaaaacccaacagtcgatggaataacagtgattgacctagaaccaataccctatgatccaaaatttgaaaagcagttaggacaagtaatgctcctagtcctctgcgtgacccaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaatgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcatccctatggtgacacagatggcaatgacagacacgactccatttggacaacaacgcgttttcaaagagaaagtggacacgagaacccaagaaccgaaggaaggcacaaagaaactaatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcggacaagtcggcacctatggccttaatactttcaccaacatggaagcccaattaattagacagatggagggagaaggaatttttaaaagcattcagcacctgacagtcacagaagaaatcgctgtacagaactggctagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaagccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccatggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacatagactacatgccatccatgaagagattcagaaaggaagaggaagaggcaggtgtcctgtggtag

SEQ ID NO: 6766 - RNA, 9876 nt, synthetic construct
  misc_feature 1..9876: note = derived and/or modified CDS sequence (wt) from DENV-2__EU687212__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgtcaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgatgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggagaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtacagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgctaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaatcgtgaaagaaatagcagaaacacaacatggaacaatagttatcagagtacaatatgaaggggacggttctccatgtaagatcccttttgagataacagatttggaaaaaagacacgtcttaggacgcctgattacagttaacccaatcataacagaaaaagatagcccagtcaacatagaagcagaacctccattcggagacagctacatcatcataggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagccatggtgcaggctgatagtggttgcgttgtgagctggaaaaataaagaactgaaatgtggcagcgggatcttcatcacagataacgtacacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcatattctatcagagaatgaagtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaagttttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccatgccagagaccattcttgaactgactgatgcgttagccttgggcatgatggtcctcaaaatagtgagaaatatggaaaaataccaattggcagtgactatcatggctatttcgtgtgtcccaaatgcagtgatattgcaaaacgcatggaaggtgagttgcacaatattggcaacggtgtccgtttctccactgctcttaacatcctcacagcagaaagcggattggataccactggcattgactataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtattgtgggacgtcccttcacccccaccagtggaaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagactgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagcaggaagacttttgactctgagtatgttaagactagagccaatgattgggactttgtggtcacaactgacatttcagaaatgggtgccaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaacgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacagctagcatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatttccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccgtccccatgtcaacatatgggtggaatctagtgcgtctgcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacaccactccatttggacaacagcgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaattcacaaaaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggggaaggaatcttcaaaagcattcagcacctgacagccacagaagaaatcgctgtacagaactggttagcaagagtggggcgtgaaaggctatcaagaatggccatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcctgtttggggaagtcttacgcccaaatgtggaccctgatgtacttccatagacgtgacctcagactggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 6767 - RNA, 9876 nt, synthetic construct
  misc_feature 1..9876: note = derived and/or modified CDS sequence (wt) from DENV-2__EU660400__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgattttcatcttactgacaaccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggctacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccggtcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacgacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactgggcgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagcatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggccacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcgaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgtggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagggacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6768 - RNA, 9876 nt, synthetic construct
  misc_feature 1..9876: note = derived and/or modified CDS sequence (wt) from DENV-2__EU569711__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgctggtgcaactctacgtccacatgggtaacttatgggacatgtaccaccacaggagaacacagaagagaaaaaagatcagtggcactcgttccacatgtaggcatgggactggagacacgaactgaaacatggatgtcatcagaaggggcctggaaacatgttcagagaattgaaacctggatcttgagacatccaggctttaccataatggcagcaatcctggcatacaccataggaacgacacattttcaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacgcaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacatcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttctccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgttaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagccagaggatatatttcaactcgagtagagatgggtgaagcagccgggattttcatgacagccactcctccgggaagtagagacccatttcctcagagcaatgcaccaattatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggatatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttctcagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6769 - RNA, 9876 nt, synthetic construct
  misc_feature 1..9876: note = derived and/or modified CDS sequence (wt) from DENV-2__EU569712__SS-prME
  source 1..9876: mol_type = other RNA
acagcaggcatgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgtccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagatacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatctctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaattgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattagaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacaactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagactattcttgaactgactgatgcgttagccttgggcatgatggtcctcaaaatagtgagaaatatggaaaagtaccaattggcagtgactatcatggctatcttgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggaggacttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtggaaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggagttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacgtttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaaccgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcacgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccagttgacctacgtagtcatagccatcctcacagtggtggccgcaaccatggcaaatgagatgggtttcctggaaaaaactaagaaagacctcggattgggaagcattataacccaggaatctgagagcaacatcctggacatagatctacgtcctgcatcagcatggacgctgtatgccgtggctacaacatttgtcacaccaatgttgagacatagcatcgaaaattcctcagtgaatgtctccctaacagccattgctaatcaggccacagtgctaatgggtcttgggagaggatggccattgtcaaagatggacatcggagttcccctccttgctattggatgctattcacaagtcaaccctataactctcacagcagcccttcttttgctggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgacccaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtagacacgagaacccaagaaccgaaggaaggcacaaagaaactaatgagaattacggcagagtggctttggaaagaactaggaaagaaaaagacacctaggatgtgtaccagagaagaatttacaagaaaagtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacattagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacggaactggctagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcgcattgggttccaacaagtcgaacaacctggtccatacacgctaagcatgaatggatgacgacggaagacatgctggcagtctggaacagggtgtggatccaagaaaacccatggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6770 - RNA, 9876 nt, synthetic construct
  misc_feature 1..9876: note = derived and/or modified CDS sequence (wt) from DENV-2__EU596487__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtatttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagttagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaattattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcatcacaacccaggaatctgagagcaacattctggacatagatctacgtcctgcatcagcatggacgctgtatgccgtggctacaacatttgtcacaccaatgttgagacatagcattgaaaattcctcagtgaatgtctccttaacagccattgctaaccaagccacagtgctaatgggtcttgggagaggatggccattgtcaaagatggacattggagttcccctccttgccattggatgctattcacaagtcaaccctataactctcacagcagctcttcttctactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtatcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactgggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttctcagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgatcgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctatggtag

SEQ ID NO: 6771 - RNA, 9876 nt, synthetic construct
  misc_feature 1..9876: note = derived and/or modified CDS sequence (wt) from DENV-2__EU569713__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtctcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgtccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtagtgacacaggaaaacatggcaaggaaattaaaataacaccacagagttccatcacagaagcagaactgacaggctatggaactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagatacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatctctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaattgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggcaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacaactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagactattcttgaactgactgatgcgttagccttgggcatgatggtcctcaaaatagtgagaaatatggaaaagtaccaattggcagtgactatcatggctatcttgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggaggacttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggagttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacgtttactatgaggctgctatcaccagtcagagtgccaaattacaacctgatcatcatggacgaagcccacttcacggatccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccagttgacctacgtagtcatagccatcctcacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcatcgaaaattcctcagtgaatgtctccctaacagccattgctaaccaggccacagtgctaatgggtcttgggagaggatggccattgtcaaagatggacatcggagttcccctccttgccattggatgctattcacaagtcaaccctataactctcacagcagcccttcttttgctggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgacccaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttctacaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtagacacgagaacccaagaaccgaaggaaggcacaaagaaactaatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacattagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggctagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccatggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaaaaggcaggtgtcctgtggtag

SEQ ID NO: 6772 - RNA, 9876 nt, synthetic construct
  misc_feature 1..9876: note = derived and/or modified CDS sequence (wt) from DENV-2__EU569714__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccgcatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaagaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagttcaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagcggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcactggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttctcactaggagtcttgggaatggctctgttcctggaagaaatgctcaggacccgagtaggaacgaaacatgtaatactgctagttgcagtatctttcgtgacattgattaccgggaacatgtcctttagagacctgggaagagtgatggttatggtgggcgctaccatgacagatgacataggtatgggagtgacttaccttgccctactagcagctttcaaagttagaccaacttttgcagctggactactcttgagaaaactgacctccaaggaactaatgatggccaccataggaatcgcacttctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagtggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgcttactggacgatcggccgatttggaactggagagagctgccgatgtaaaatgggaagaccaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagatgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccgcagtcacaggaggaatcttcctattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagcccttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaagaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactagggaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttaggaaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6773 - RNA, 9876 nt, synthetic construct
  misc_feature 1..9876: note = derived and/or modified CDS sequence (wt) from DENV-2__EU569715__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttagaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaagggcgtataatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactggaagacttaaaaaatgaagaaatggtaacaaaccacatgaaaggagaacacaagaaactagccgaggccatattcaaattaacgtaccaaaacaaggtggtgcgtgtgcaaagaccaacaccaggaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag
